United States Patent
Martini et al.

(10) Patent No.: US 10,406,112 B2
(45) Date of Patent: *Sep. 10, 2019

(54) POLYNUCLEOTIDES ENCODING METHYLMALONYL-COA MUTASE

(71) Applicant: ModernaTX, Inc., Cambridge, MA (US)

(72) Inventors: Paolo Martini, Boston, MA (US); Vladimir Presnyak, Cambridge, MA (US); Kerry Benenato, Sudbury, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/002,376

(22) Filed: Jun. 7, 2018

(65) Prior Publication Data

US 2018/0271795 A1 Sep. 27, 2018

Related U.S. Application Data

(63) Continuation of application No. PCT/US2016/067393, filed on Dec. 16, 2016.

(60) Provisional application No. 62/409,343, filed on Oct. 17, 2016, provisional application No. 62/338,478, filed on May 18, 2016, provisional application No. 62/338,456, filed on May 18, 2016, provisional application No. 62/274,727, filed on Jan. 4, 2016, provisional application No. 62/274,722, filed on Jan. 4, 2016, provisional application No. 62/274,733, filed on Jan. 4, 2016, provisional application No. 62/274,726, filed on Jan. 4, 2016, provisional application No. 62/273,112, filed on Dec. 30, 2015, provisional application No. 62/273,108, filed on Dec. 30, 2015, provisional application No. 62/269,089, filed on Dec. 17, 2015, provisional application No. 62/269,092, filed on Dec. 17, 2015.

(51) Int. Cl.
| | | |
|---|---|---|
| *C12N 15/11* | (2006.01) | |
| *A61K 9/51* | (2006.01) | |
| *A61K 9/127* | (2006.01) | |
| *C12N 9/90* | (2006.01) | |
| *A61P 3/00* | (2006.01) | |
| *A61P 43/00* | (2006.01) | |
| *A61K 38/52* | (2006.01) | |
| *A61K 48/00* | (2006.01) | |
| *C12N 15/52* | (2006.01) | |
| *A61K 38/00* | (2006.01) | |

(52) U.S. Cl.
CPC .......... *A61K 9/5123* (2013.01); *A61K 9/1272* (2013.01); *A61K 38/52* (2013.01); *A61K 48/005* (2013.01); *A61P 3/00* (2018.01); *A61P 43/00* (2018.01); *C12N 9/90* (2013.01); *C12N 15/52* (2013.01); *C12Y 504/99002* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 8,691,966 B2 | 4/2014 | Kariko et al. | |
| 9,719,080 B2 | 8/2017 | Venditti et al. | |
| 9,821,114 B2 | 11/2017 | Aquino et al. | |
| 9,868,691 B2 | 1/2018 | Benenato | |
| 9,944,918 B2 | 4/2018 | Venditti et al. | |
| 10,072,057 B2 | 9/2018 | Hoge et al. | |
| 2007/0122885 A1 | 5/2007 | Reeves et al. | |
| 2013/0259924 A1* | 10/2013 | Bancel | A61K 48/005 424/450 |
| 2016/0040150 A1* | 2/2016 | Venditti | C12N 9/90 514/44 R |
| 2018/0126003 A1 | 5/2018 | Hoerr | |
| 2018/0126005 A1 | 5/2018 | Fotin-Mleczek et al. | |
| 2018/0289838 A1 | 10/2018 | Martini et al. | |
| 2019/0022019 A1 | 1/2019 | Martini et al. | |

FOREIGN PATENT DOCUMENTS

| | | |
|---|---|---|
| WO | WO 95/27512 | 10/1995 |
| WO | WO 2013/086373 | 6/2013 |
| WO | WO 2013/151666 | 10/2013 |
| WO | WO 2014/143884 | 9/2014 |
| WO | WO 2014/152513 | 9/2014 |
| WO | WO 2015/017519 | 2/2015 |
| WO | WO 2016/118697 | 7/2016 |
| WO | WO 2016/172574 | 10/2016 |

(Continued)

OTHER PUBLICATIONS

International Preliminary Report on Patentability in International Application No. PCT/US2016/067393, dated Jun. 19, 2018, 11 pages.

(Continued)

*Primary Examiner* — Dana H Shin

(74) *Attorney, Agent, or Firm* — Fish & Richardson P.C.

(57) ABSTRACT

The disclosure relates to polynucleotides comprising an open reading frame of linked nucleosides encoding human methylmalonyl-CoA mutase precursor, human methylmalonyl-CoA mutase (MCM) mature form, or functional fragments thereof. In some embodiments, the disclosure includes methods of treating methylmalonic acidemia in a subject in need thereof comprising administering an mRNA encoding an MCM polypeptide.

24 Claims, 21 Drawing Sheets

Specification includes a Sequence Listing.

(56) References Cited

FOREIGN PATENT DOCUMENTS

| WO | WO-2017049245 A2 * | 3/2017 | ........... A61K 9/5123 |
|---|---|---|---|
| WO | WO 2017/100551 | 6/2017 | |
| WO | WO 2017/106799 | 6/2017 | |
| WO | WO 2017/147720 | 9/2017 | |
| WO | WO 2017/153936 | 9/2017 | |
| WO | WO 2017/191274 | 11/2017 | |

OTHER PUBLICATIONS

U.S. Appl. No. 16/002,472, filed Jun. 7, 2018, Pending.
U.S. Appl. No. 16/002,472, filed Jun. 7, 2018, Martini et al.
International Search Report and Written Opinion in International Application No. PCT/US2016/067393, dated Mar. 16, 2017, 14 pages.
NCBI Accession No. BAF85257, "unnamed protein product [*Homo sapiens*]," Jan. 9, 2008, 2 pages.
NCBI Accession No. NP_000246, "methylmalonyl Coenzyme A mutase precursor [*Homo sapiens*]," Jun. 26, 2007, 4 pages.
Sahin et al., "mRNA-based therapeutics—developing a new class of drugs," Nature of Reviews Drug Discovery, 13(10):759-780 (Sep. 2014).
An et al., "Systemic messenger RNA therapy as a treatment for methylmalonic acidemia," Cell Reports, 2017, 21(12): 3548-3558.

\* cited by examiner

Mouse α–Methymalonyl-CoA mutase ( → )
Rabbit α–Citrate synthetase ( ⇒ )

MCM: Mouse α-Methymalonyl-CoA mutase (TA505873_2C8)
CS: Rabbit α-Citrate synthetase

FIG. 9

```
ATGCTGCGGGCCAAGAACCAGCTGTTCCTGCTGAGCCCTCACTACCTGCGGCAGGTGAA
GGAGAGCAGCGGCAGCCGGCTGATCCAGCAGCGGCTGCTGCACCAGCAGCAGCCCCTGC
ACCCCGAGTGGGCCGCCCTGGCCAAGAAGCAGCTGAAGGGCAAGAACCCCGAGGACCTG
ATCTGGCACACGCCCGAGGGCATCAGCATCAAGCCCCTGTACAGCAAGCGGGACACCAT
GGACCTGCCCGAGGAGCTGCCCGGCGTGAAGCCCTTCACCCGGGGCCCCTACCCCACCA
TGTACACCTTCCGGCCCTGGACCATCCGGCAGTACGCCGGCTTCAGCACCGTGGAGGAG
AGCAACAAGTTCTACAAGGACAACATCAAGGCCGGCCAGCAGGGCCTGAGCGTGGCCTT
CGACCTGGCCACCCACCGGGGCTACGACAGCGACAACCCACGGGTGCGGGGCGACGTGG
GCATGGCCGGCGTGGCCATCGACACCGTGGAGGACACCAAGATCCTGTTCGACGGCATC
CCTCTGGAGAAGATGAGCGTGAGCATGACCATGAACGGCGCCGTGATCCCCGTGCTGGC
CAACTTCATCGTGACCGGCGAGGAGCAGGGCGTGCCCAAGGAGAAGCTGACCGGCACCA
TCCAGAACGACATCCTGAAGGAGTTCATGGTGCGGAACACCTACATCTTCCCTCCCGAG
CCCAGCATGAAGATCATCGCCGACATCTTCGAGTACACCGCCAAGCACATGCCCAAGTT
CAACAGCATCAGCATCAGCGGCTACCACATGCAGGAGGCCGGCGCCGACGCCATCCTGG
AGCTGGCCTACACCCTGGCCGACGGCCTGGAGTACAGCCGGACCGGCCTGCAGGCCGGC
CTGACCATCGACGAGTTCGCGCCCCGGCTGAGCTTCTTCTGGGGCATCGGCATGAACTT
CTACATGGAGATCGCCAAGATGCGGGCCGGCCGGCGGCTGTGGGCCCACCTGATCGAGA
AGATGTTCCAGCCCAAGAACAGCAAGAGCCTGCTGCTGCGGGCCCACTGCCAGACCAGC
GGCTGGAGCCTGACCGAGCAGGACCCCTACAACAACATCGTGCGGACCGCCATCGAGGC
CATGGCCGCCGTGTTCGGCGGCACCCAGAGCCTGCACACCAACAGCTTCGACGAGGCCC
TGGGCCTGCCCACCGTGAAGAGCGCCCGGATCGCCCGGAACACCCAGATCATCATCCAG
GAGGAGAGCGGCATCCCCAAGGTGGCCGACCCCTGGGCGGCAGCTACATGATGGAGTG
CCTGACCAACGACGTGTACGACGCCGCCCTGAAGCTGATCAACGAGATCGAGGAGATGG
GCGGCATGGCCAAGGCCGTGGCCGAGGGCATCCCCAAGCTGCGGATCGAGGAGTGCGCC
GCCCGGCGGCAGGCCCGGATCGACAGCGGCAGCGAGGTGATCGTGGGCGTGAACAAGTA
CCAGCTGGAGAAGGAGGACGCCGTGGAGGTGCTGGCCATCGACAACACCAGCGTGCGGA
ACCGGCAGATCGAGAAGCTGAAGAAGATCAAGAGCAGCCGGGACCAGGCCCTGGCCGAG
CGGTGCCTGGCCGCCCTGACCGAGTGCGCCGCCAGCGGCGACGGCAACATCCTGGCCCT
GGCCGTGGACGCCAGCCGGGCCCGGTGCACCGTGGGCGAGATCACCGACGCCCTGAAGA
AGGTGTTCGGCGAGCACAAGGCCAACGACCGGATGGTGAGCGGCGCCTACCGGCAGGAG
TTCGGCGAGAGCAAGGAGATCACCAGCGCCATCAAGCGGGTGCACAAGTTCATGGAGCG
GGAGGGCCGGCGGCCCCGGCTGCTGGTGGCCAAGATGGGCCAGGACGGCCACGACCGGG
GCGCCAAGGTGATCGCCACCGGCTTCGCCGACCTGGGCTTCGACGTGGACATCGGCCCA
CTGTTCCAGACGCCCCGGGAGGTGGCCCAGCAGGCCGTGGACGCCGACGTGCACGCCGT
GGGCGTGAGCACCCTGGCCGCCGGCCACAAGACCCTGGTGCCCGAGCTGATCAAGGAGC
TGAACAGCCTGGGCCGGCCCGACATCCTGGTGATGTGCGGCGGCGTGATCCCGCCCCAG
GACTACGAGTTCCTGTTCGAGGTGGGCGTGAGCAACGTGTTCGGCCCCGGCACCCGGAT
CCCCAAGGCCGCCGTGCAGGTGCTGGACGACATCGAGAAGTGCCTGGAGAAGAAGCAGC
AGAGCGTG
```

SEQ ID NO: 732

FIG. 10

ATGCTGCGGGCCAAGAACCAGCTGTTCCTGCTGAGCCCGCACTACCTGCGGCAGGTGAA
GGAGAGCAGCGGCAGCCGGCTGATCCAGCAGCGCCTCCTCCACCAGCAGCAGCCCCTCC
ACCCCGAGTGGGCCGCCCTCGCCAAGAAGCAGCTCAAGGGCAAGAACCCCGAGGACCTC
ATCTGGCACACGCCCGAGGGCATCTCCATCAAGCCCTCTACTCCAAGCGCGACACCAT
GGACCTCCCCGAGGAGCTCCCCGGCGTCAAGCCCTTCACCCGCGGCCCCTACCCCACCA
TGTACACCTTCCGCCCCTGGACCATCCGCCAGTACGCCGGCTTCTCCACCGTCGAGGAG
TCCAACAAGTTCTACAAGGACAACATCAAGGCCGGCCAGCAGGGCCTCTCCGTCGCCTT
CGACCTCGCCACCCACCGCGGCTACGACTCCGACAACCCGCGCGTCCGCGGCGACGTCG
GCATGGCCGGCGTCGCCATCGACACCGTCGAGGACACCAAGATCCTCTTCGACGGCATC
CCTCTCGAGAAGATGTCCGTCTCCATGACCATGAACGGCGCCGTCATCCCCGTCCTCGC
CAACTTCATCGTCACCGGCGAGGAGCAGGGCGTCCCCAAGGAGAAGCTCACCGGCACCA
TCCAGAACGACATCCTCAAGGAGTTCATGGTCCGCAACACCTACATCTTCCCTCCCGAG
CCCTCCATGAAGATCATCGCCGACATCTTCGAGTACACCGCCAAGCACATGCCCAAGTT
CAACTCCATCTCCATCTCCGGCTACCACATGCAGGAGGCCGGCGCCGACGCCATCCTCG
AGCTCGCCTACACCCTCGCCGACGGCCTCGAGTACTCCCGCACCGGCCTCCAGGCCGGC
CTCACCATCGACGAGTTCGCGCCCCGCCTCTCCTTCTTCTGGGGCATCGGCATGAACTT
CTACATGGAGATCGCCAAGATGCGCGCCGGCCGCCGCCTCTGGGCCCACCTCATCGAGA
AGATGTTCCAGCCCAAGAACTCCAAGTCCCTCCTCCTCCGCGCCCACTGCCAGACCTCC
GGCTGGTCCCTCACCGAGCAGGACCCCTACAACAACATCGTCCGCACCGCCATCGAGGC
CATGGCCGCCGTCTTCGGCGGCACCCAGTCCCTCCACACCAACTCCTTCGACGAGGCCC
TCGGCCTCCCCACCGTCAAGTCCGCCCGCATCGCCCGCAACACCCAGATCATCATCCAG
GAGGAGTCCGGCATCCCCAAGGTCGCCGACCCCTGGGGCGGCTCCTACATGATGGAGTG
CCTCACCAACGACGTCTACGACGCCGCCCTCAAGCTCATCAACGAGATCGAGGAGATGG
GCGGCATGGCCAAGGCCGTCGCCGAGGGCATCCCCAAGCTCCGCATCGAGGAGTGCGCC
GCCCGCCGCCAGGCCCGCATCGACTCCGGCTCCGAGGTCATCGTCGGCGTCAACAAGTA
CCAGCTCGAGAAGGAGGACGCCGTCGAGGTCCTCGCCATCGACAACACCTCCGTCCGCA
ACCGCCAGATCGAGAAGCTCAAGAAGATCAAGTCCTCCCGCGACCAGGCCCTCGCCGAG
CGCTGCCTCGCCGCCCTCACCGAGTGCGCCGCCTCCGGCGACGGCAACATCCTCGCCCT
CGCCGTCGACGCCTCCCGCGCCCGCTGCACCGTCGGCGAGATCACCGACGCCCTCAAGA
AGGTCTTCGGCGAGCACAAGGCCAACGACCGCATGGTCTCCGGCGCCTACCGCCAGGAG
TTCGGCGAGTCCAAGGAGATCACCTCCGCCATCAAGCGCGTCCACAAGTTCATGGAGCG
CGAGGGCCGCCGCCCGCGCCTCCTCGTCGCCAAGATGGGCCAGGACGGCCACGACCGCG
GCGCCAAGGTCATCGCCACCGGCTTCGCCGACCTCGGCTTCGACGTCGACATCGGCCCA
CTCTTCCAGACGCCCCGCGAGGTCGCCCAGCAGGCCGTCGACGCCGACGTCCACGCCGT
CGGCGTCTCCACCCTCGCCGCCGGCCACAAGACCCTCGTCCCCGAGCTCATCAAGGAGC
TCAACTCCCTCGGCCGCCCCGACATCCTCGTCATGTGCGGCGGCGTCATCCCTCCCCAG
GACTACGAGTTCCTCTTCGAGGTCGGCGTCTCCAACGTCTTCGGCCCCGGCACCCGCAT
CCCCAAGGCCGCCGTCCAGGTCCTCGACGACATCGAGAAGTGCCTCGAGAAGAAGCAGC
AGTCCGTC

SEQ ID NO: 733

FIG. 11

```
ATGCTGCGGGCCAAGAACCAGCTGTTCCTGCTGAGCCCCCACTACCTGCGGCAGGTGAA
GGAGAGCAGCGGCAGCCGGCTGATCCAGCAGCGGCTGCTGCACCAGCAGCAGCCCCTGC
ACCCCGAGTGGGCCGCCCTGGCCAAGAAGCAGCTGAAGGGCAAGAACCCCGAGGACCTG
ATCTGGCACACCCCGAGGGCATCAGCATCAAGCCCCTGTACAGCAAGCGGGACACCAT
GGACCTGCCCGAGGAGCTGCCCGGCGTGAAGCCCTTCACCCGGGGCCCCTACCCCACCA
TGTACACCTTCCGGCCCTGGACCATCCGGCAGTACGCCGGCTTCAGCACCGTGGAGGAG
AGCAACAAGTTCTACAAGGACAACATCAAGGCCGGCCAGCAGGGCCTGAGCGTGGCCTT
CGACCTGGCCACCCACCGGGGCTACGACAGCGACAACCCCGGGTGCGGGGCGACGTGG
GCATGGCCGGCGTGGCCATCGACACCGTGGAGGACACCAAGATCCTGTTCGACGGCATC
CCCCTGGAGAAGATGAGCGTGAGCATGACCATGAACGGCGCCGTGATCCCCGTGCTGGC
CAACTTCATCGTGACCGGCGAGGAGCAGGGCGTGCCCAAGGAGAAGCTGACCGGCACCA
TCCAGAACGACATCCTGAAGGAGTTCATGGTGCGGAACACCTACATCTTCCCCCCCGAG
CCCAGCATGAAGATCATCGCCGACATCTTCGAGTACACCGCCAAGCACATGCCCAAGTT
CAACAGCATCAGCATCAGCGGCTACCACATGCAGGAGGCCGGCGCCGACGCCATCCTGG
AGCTGGCCTACACCCTGGCCGACGGCCTGGAGTACAGCCGGACCGGCCTGCAGGCCGGC
CTGACCATCGACGAGTTCGCCCCCGGCTGAGCTTCTTCTGGGGCATCGGCATGAACTT
CTACATGGAGATCGCCAAGATGCGGGCCGGCCGGCGGCTGTGGGCCCACCTGATCGAGA
AGATGTTCCAGCCCAAGAACAGCAAGAGCCTGCTGCTGCGGGCCCACTGCCAGACCAGC
GGCTGGAGCCTGACCGAGCAGGACCCCTACAACAACATCGTGCGGACCGCCATCGAGGC
CATGGCCGCCGTGTTCGGCGGCACCCAGAGCCTGCACACCAACAGCTTCGACGAGGCCC
TGGGCCTGCCCACCGTGAAGAGCGCCCGGATCGCCCGGAACACCCAGATCATCATCCAG
GAGGAGAGCGGCATCCCCAAGGTGGCCGACCCCTGGGGCGGCAGCTACATGATGGAGTG
CCTGACCAACGACGTGTACGACGCCGCCCTGAAGCTGATCAACGAGATCGAGGAGATGG
GCGGCATGGCCAAGGCCGTGGCCGAGGGCATCCCCAAGCTGCGGATCGAGGAGTGCGCC
GCCCGGCGGCAGGCCCGGATCGACAGCGGCAGCGAGGTGATCGTGGGCGTGAACAAGTA
CCAGCTGGAGAAGGAGGACGCCGTGGAGGTGCTGGCCATCGACAACACCAGCGTGCGGA
ACCGGCAGATCGAGAAGCTGAAGAAGATCAAGAGCAGCCGGGACCAGGCCCTGGCCGAG
CGGTGCCTGGCCGCCCTGACCGAGTGCGCCGCCAGCGGCGACGGCAACATCCTGGCCCT
GGCCGTGGACGCCAGCCGGGCCCGGTGCACCGTGGGCGAGATCACCGACGCCCTGAAGA
AGGTGTTCGGCGAGCACAAGGCCAACGACCGGATGGTGAGCGGCGCCTACCGGCAGGAG
TTCGGCGAGAGCAAGGAGATCACCAGCGCCATCAAGCGGGTGCACAAGTTCATGGAGCG
GGAGGGCCGGCGGCCCCGGCTGCTGGTGGCCAAGATGGGCCAGGACGGCCACGACCGGG
GCGCCAAGGTGATCGCCACCGGCTTCGCCGACCTGGGCTTCGACGTGGACATCGGCCCC
CTGTTCCAGACCCCCGGGAGGTGGCCCAGCAGGCCGTGGACGCCGACGTGCACGCCGT
GGGCGTGAGCACCCTGGCCGCCGGCCACAAGACCCTGGTGCCCGAGCTGATCAAGGAGC
TGAACAGCCTGGGCCGGCCCGACATCCTGGTGATGTGCGGCGGCGTGATCCCCCCCCAG
GACTACGAGTTCCTGTTCGAGGTGGGCGTGAGCAACGTGTTCGGCCCCGGCACCCGGAT
CCCCAAGGCCGCCGTGCAGGTGCTGGACGACATCGAGAAGTGCCTGGAGAAGAAGCAGC
AGAGCGTG
```

SEQ ID NO: 734

FIG. 12

```
ATGCTGAGAGCCAAGAACCAGCTGTTCCTGCTGAGCCCTCACTACCTGAGACAGGTAAA
GGAGAGCAGCGGCTCAAGGCTGATCCAACAGAGGTTGCTGCACCAGCAGCAGCCCCTTC
ATCCCGAGTGGGCAGCTCTGGCCAAGAAACAGTTGAAGGGCAAGAACCCCGAGGACCTG
ATTTGGCATACCCCCGAGGGCATCAGCATCAAGCCTCTGTACTCCAAGCGCGACACCAT
GGACCTCCCCGAGGAACTGCCCGGGGTGAAACCATTTACACGCGGCCCCTACCCCACCA
TGTACACCTTCCGGCCATGGACGATTAGGCAGTACGCTGGCTTCAGCACGGTGGAGGAG
AGCAATAAGTTCTACAAGGACAACATCAAGGCAGGGCAGCAGGGGCTTAGCGTGGCCTT
TGACCTGGCCACACACCGGGGTACGACAGCGACAATCCCAGGGTGCGGGGCGACGTTG
GCATGGCCGGCGTTGCTATCGATACCGTGGAGGATACGAAGATACTGTTTGACGGGATC
CCCCTGGAGAAAATGAGCGTGAGCATGACAATGAACGGCGCTGTGATCCCTGTCCTCGC
TAACTTCATCGTTACCGGCGAGGAACAGGGAGTACCTAAGGAAAAGCTGACTGGAACTA
TTCAGAATGACATTCTCAAGGAATTCATGGTCAGGAACACTTATATCTTTCCCCCTGAA
CCGTCTATGAAAATCATAGCAGACATTTTTGAGTATACCGCCAAGCACATGCCCAAGTT
TAACAGCATCTCCATCTCTGGCTACCACATGCAGGAGGCAGGCGCCGACGCTATTCTGG
AGCTGGCGTACACTCTCGCCGACGGACTGGAGTACTCTCGCACTGGACTCCAGGCCGGG
CTGACCATCGATGAGTTCGCACCGAGGCTGTCCTTCTTCTGGGGCATTGGAATGAACTT
TTACATGGAGATCGCTAAGATGCGAGCAGGCCGGAGACTGTGGGCCCACCTGATTGAAA
AAATGTTCCAACCTAAGAATTCCAAGAGCCTGCTGTTGAGAGCCCACTGCCAGACCAGC
GGCTGGTCGCTGACCGAGCAGGACCCCTACAATAACATAGTGCGGACCGCTATTGAAGC
CATGGCCGCCGTTTTTGGCGGCACTCAGAGCCTGCACACCAACAGCTTTGACGAGGCCC
TGGGCCTGCCCACTGTGAAGAGTGCCAGAATCGCCAGGAATACCCAGATTATCATTCAG
GAGGAGTCAGGAATACCCAAAGTGGCCGACCCCTGGGGGGGTAGCTACATGATGGAGTG
CCTGACAAACGACGTGTACGATGCCGCCCTCAAGCTGATCAACGAGATCGAGGAAATGG
GCGGCATGGCCAAGGCTGTTGCCGAAGGCATCCCCAAGCTCCGGATTGAAGAGTGTGCG
GCCAGGAGACAGGCTAGGATAGACAGCGGCAGCGAAGTGATCGTCGGCGTTAACAAATA
CCAGCTGGAAAAGGAAGATGCTGTGGAGGTGCTGGCCATCGACAACACCTCCGTTCGGA
ACAGACAAATCGAGAAGCTGAAGAAAATCAAGAGCAGCAGAGACCAGGCCCTTGCTGAG
CGCTGTCTGGCCGCACTAACCGAATGCGCCGCCAGCGGCGATGGGAATATCCTGGCCCT
GGCCGTGGACGCTTCTAGGGCAAGATGCACAGTGGGCGAGATCACAGACGCTCTGAAGA
AGGTCTTCGGCGAGCATAAAGCCAACGACCGGATGGTGAGCGGAGCATACCGGCAGGAG
TTCGGCGAGAGCAAAGAAATTACCTCTGCCATCAAACGCGTGCATAAGTTTATGGAGCG
GGAGGGCAGGAGACCGCGGCTGTTGGTGGCCAAAATGGGACAAGATGGCCACGATCGCG
GTGCCAAGGTGATCGCCACCGGGTTCGCTGACCTGGGCTTCGACGTTGATATAGGCCCT
CTTTTCCAGACACCTCGGGAGGTGGCTCAACAGGCTGTGGATGCCGACGTCCACGCAGT
GGGCGTGAGCACCCTGGCCGCCGGCCACAAGACCCTGGTGCCCGAGTTAATCAAGGAGT
TGAATTCACTGGGCAGACCTGACATCCTGGTGATGTGCGGCGGCGTCATCCCCCCGCAG
GATTACGAGTTCCTGTTCAGGTGGGAGTGAGCAACGTGTTCGGTCCTGGCACACGGAT
CCCCAAGGCCGCCGTCCAGGTTCTGGACGACATCGAGAAGTGCCTGGAAAAGAAACAGC
AGTCCGTG
```

SEQ ID NO: 151

FIG. 13

```
ATGCTGAGAGCCAAAAATCAGCTCTTCCTACTGAGCCCTCATTACCTGAGGCAGGTGAA
GGAGAGCTCAGGGAGCCGGCTCATCCAGCAGAGACTGCTCCATCAGCAGCAGCCGCTGC
ACCCGGAGTGGGCCGCCCTGGCCAAGAAACAACTGAAGGGCAAGAACCCAGAGGACCTT
ATTTGGCACACCCCAGAGGGCATTAGCATCAAGCCTCTCTATAGCAAGAGAGACACCAT
GGACCTCCCCGAGGAGCTGCCCGGCGTGAAGCCTTTCACCCGTGGCCCCTACCCAACCA
TGTACACATTCAGGCCCTGGACTATCCGGCAGTACGCGGGCTTCTCTACCGTGGAGGAG
TCCAACAAGTTCTACAAGGACAATATTAAAGCTGGCCAGCAGGGACTGAGCGTGGCCTT
CGATTTGGCCACCCACAGAGGATACGACAGCGACAACCCCAGGGTGAGGGGCGACGTTG
GAATGGCCGGCGTGGCCATTGATACTGTCGAGGACACCAAGATCCTGTTCGATGGGATA
CCCCTCGAAAAAATGTCTGTGTCCATGACAATGAATGGGGCCGTGATCCCAGTGTTGGC
CAATTTTATCGTGACAGGAGAGGAGCAGGGCGTGCCCAAGGAGAAGCTGACCGGCACCA
TCCAGAACGACATCTTGAAAGAATTCATGGTTAGAAATACCTACATCTTTCCTCCCGAA
CCCAGCATGAAGATCATCGCCGATATCTTCGAGTATACCGCCAAACACATGCCCAAATT
CAACTCCATTAGCATATCCGGATACCATATGCAGGAGGCTGGCGCCGACGCCATCCTGG
AGCTGGCGTACACCCTGGCCGATGGCCTGGAATATTCTAGGACCGGCCTGCAGGCTGGA
CTCACAATCGATGAGTTCGCCCCCGCCTGAGCTTCTTCTGGGGCATCGGCATGAACTT
CTACATGGAGATCGCTAAGATGAGAGCGGGACGCCGCCTGTGGGCTCACCTGATCGAAA
AAATGTTCCAACCTAAGAATAGCAAGTCTCTGCTCCTGCGGGCACACTGTCAAACCTCC
GGCTGGTCCCTTACAGAACAGGACCCGTACAACAACATCGTGAGAACCGCCATCGAAGC
CATGGCGGCCGTGTTCGGGGGCACCCAGTCACTCCACACCAATAGCTTCGACGAGGCCC
TGGGCTTGCCTACTGTCAAGTCTGCCAGGATCGCCAGGAACACTCAGATTATCATCCAG
GAGGAGAGCGGCATTCCTAAGGTAGCTGACCCCTGGGGGGGAAGCTACATGATGGAATG
CCTCACCAACGACGTGTACGATGCCGCCCTGAAGCTGATTAATGAGATCGAGGAAATGG
GGGGCATGGCCAAGGCTGTAGCCGAGGGAATCCCCAAGCTGAGAATCGAGGAGTGCGCC
GCCAGGCGGCAGGCCCGCATCGATAGTGGCAGCGAGGTGATCGTGGGCGTTAACAAGTA
CCAGCTCGAGAAGGAAGACGCCGTAGAGGTGTTGGCAATCGACAATACCTCCGTGAGAA
ATAGGCAGATCGAGAAGCTAAAGAAGATAAAGAGCAGCCGGGACCAGGCTCTGGCAGAA
CGGTGCCTGGCCGCCCTCACTGAATGCGCCGCTTCTGGCGATGGCAACATTCTGGCCCT
TGCCGTCGATGCCAGCCGGGCCCGATGCACTGTGGGAGAGATCACAGACGCTCTGAAGA
AGGTGTTCGGCGAGCATAAAGCAAACGATAGAATGGTGTCCGGCGCCTACAGGCAGGAG
TTTGGCGAGAGCAAGGAGATCACATCTGCTATTAAGAGAGTGCATAAGTTCATGGAGAG
AGAGGGACGGCGGCCTAGACTGCTGGTAGCAAAGATGGGCCAGGACGGCCACGATCGGG
GAGCAAAGGTCATTGCTACCGGGTTCGCCGACCTGGGCTTCGACGTGGACATTGGCCCC
CTCTTCCAGACCCCCCGCGAAGTTGCTCAGCAGGCTGTGGATGCTGACGTGCACGCTGT
GGGCGTCAGCACACTGGCCGCTGGACATAAGACCCTGGTTCCCGAGCTGATCAAGGAGC
TGAATAGCCTGGGTCGGCCAGACATCCTCGTGATGTGCGGGGGTGTGATCCCCCCTCAG
GATTACGAGTTCCTGTTCGAGGTTGGAGTCTCTAATGTGTTCGGCCCCGGAACAAGAAT
CCCGAAGGCCGCTGTGCAAGTCCTGGACGACATCGAAAAGTGCCTCGAGAAGAAGCAGC
AGTCTGTG
```

SEQ ID NO: 152

FIG. 14

```
ATGCTGAGGGCCAAGAACCAGCTGTTCCTCCTGTCTCCTCACTACCTGAGACAGGTGAA
GGAGTCCAGCGGTAGCAGACTGATCCAGCAGAGGCTGCTTCACCAGCAGCAGCCCCTCC
ATCCGGAGTGGGCTGCACTGGCAAAAAAGCAGCTTAAGGGAAAAAACCCCGAGGACCTG
ATTTGGCACACCCCAGAGGGAATTAGCATTAAACCCCTCTACAGCAAACGGGACACGAT
GGACCTGCCCGAGGAACTGCCCGGCGTGAAGCCCTTCACACGGGGCCCATACCCCACAA
TGTATACATTCCGTCCTTGGACCATTCGCCAATACGCCGGGTTCAGCACGGTGGAGGAA
TCCAACAAGTTCTACAAGGACAACATCAAGGCCGGCCAGCAAGGCCTCAGCGTCGCCTT
TGACTTGGCCACCCACAGAGGCTACGACTCCGACAACCCCAGAGTGAGAGGCGACGTGG
GTATGGCCGGCGTGGCCATCGACACTGTTGAGGACACCAAAATCCTATTTGACGGCATA
CCCCTGGAAAAGATGTCCGTGAGCATGACAATGAATGGCGCTGTGATCCCCGTGCTCGC
TAACTTCATCGTGACCGGCGAGGAGCAGGGTGTCCCTAAGGAGAAACTTACCGGCACAA
TCCAGAACGACATTCTCAAGGAGTTTATGGTGCGCAACACCTACATTTTCCCCCCAGAG
CCTAGCATGAAGATCATTGCCGACATCTTCGAGTACACCGCCAAGCATATGCCAAAGTT
TAACTCCATTTCAATCTCTGGCTACCATATGCAGGAAGCTGGCGCTGACGCCATCTTAG
AGCTGGCCTACACCTTGGCCGACGGCCTCGAATACAGCAGGACCGGCCTTCAGGCCGGT
CTGACCATTGACGAATTTGCACCCAGACTGAGCTTCTTCTGGGGCATCGGCATGAACTT
CTATATGGAGATCGCTAAAATGAGAGCCGGCCGGAGACTGTGGGCTCACCTGATCGAGA
AAATGTTTCAACCCAAGAACTCCAAAAGCCTTCTGCTCAGGGCCCATTGTCAAACCTCT
GGATGGAGCCTGACTGAGCAGGACCCGTATAACAACATCGTCAGGACCGCCATCGAGGC
CATGGCTGCGGTGTTTGGCGGAACCCAGTCCTTACACACAAATAGCTTTGACGAAGCCC
TGGGGCTGCCAACCGTGAAAAGCGCCAGAATCGCCCGGAATACTCAGATAATCATCCAG
GAGGAGTCCGGGATCCCCAAGGTTGCCGACCCCTGGGGGGGAAGTTACATGATGGAGTG
CTTGACCAACGATGTGTACGATGCTGCTCTGAAGCTGATTAACGAGATTGAGGAGATGG
GAGGCATGGCTAAGGCTGTCGCGGAGGGCATCCCTAAGCTGAGAATCGAGGAGTGCGCC
GCCCGCCGGCAGGCCAGGATTGACAGCGGATCTGAGGTGATCGTGGGGGTGAACAAGTA
CCAGCTGGAGAAGGAGGACGCCGTTGAGGTTCTGGCTATCGACAACACCAGCGTCAGAA
ACAGGCAGATCGAGAAGCTGAAGAAAATCAAAAGCAGCAGAGACCAGGCCCTGGCAGAA
AGATGCCTGGCTGCCCTGACCGAGTGCGCTGCTAGCGGAGACGGGAACATCCTGGCTCT
GGCCGTCGACGCTTCCAGAGCCAGGTGTACCGTCGGCGAGATCACCGACGCCCTGAAGA
AAGTGTTCGGCGAGCACAAGGCCAACGACCGCATGGTGTCCGGCGCCTACAGGCAGGAG
TTCGGCGAGTCCAAGGAGATTACCTCCGCCATCAAACGGGTGCACAAATTCATGGAGAG
AGAGGGCAGACGGCCACGCTTGCTCGTGGCCAAGATGGGGCAGGACGGCCACGATAGGG
GCGCTAAGGTTATCGCTACAGGCTTTGCTGATCTGGGCTTCGACGTGGACATCGGCCCC
CTGTTTCAGACCCCTAGAGAGGTAGCTCAGCAGGCCGTCGACGCCGACGTGCACGCCGT
GGGCGTCAGCACACTGGCAGCCGGACACAAGACCCTCGTGCCCGAGCTTATCAAGGAAC
TGAACTCCTTGGGGCGGCCCGACATCCTCGTCATGTGCGGCGGAGTGATTCCCCCCCAG
GACTATGAGTTCCTGTTCGAGGTCGGCGTAAGCAACGTCTTTGGCCCCGGAACTCGGAT
CCCCAAGGCCGCAGTACAGGTGCTGGACGACATCGAAAAGTGCCTGGAGAAGAAGCAAC
AGTCTGTG
```

SEQ ID NO: 153

FIG. 15

```
ATGCTGCGCGCTAAAAACCAACTATTCCTGCTGTCCCCCCATTACCTGAGACAGGTGAA
GGAGAGCTCCGGAAGCAGGCTGATCCAACAGAGACTTCTGCACCAGCAGCAGCCCCTGC
ATCCCGAGTGGGCCGCTCTGGCTAAGAAACAACTGAAGGGAAAGAACCCCGAGGACCTG
ATCTGGCACACCCCAGAGGGCATATCCATCAAGCCCCTGTATTCTAAGAGGGACACTAT
GGACCTGCCCGAGGAGCTCCCCGGCGTCAAGCCTTTCACACGCGGACCTTACCCCACAA
TGTACACATTCCGACCATGGACCATTAGGCAGTACGCAGGATTCAGCACCGTTGAGGAG
TCCAATAAATTCTATAAGGACAATATTAAGGCCGGACAACAGGGCCTGAGTGTGGCATT
CGACCTGGCCACACACAGAGGTTACGACTCCGATAATCCTAGGGTGAGAGGCGACGTGG
GCATGGCTGGAGTGGCCATCGATACCGTCGAGGACACAAAGATCCTGTTCGACGGCATC
CCCTTGGAGAAAATGTCCGTGAGCATGACCATGAACGGCGCCGTGATTCCCGTGCTGGC
CAACTTTATTGTAACCGGCGAGGAGCAGGGCGTCCCCAAGGAGAAGCTGACCGGCACCA
TCCAGAACGATATCCTCAAGGAGTTCATGGTACGGAATACCTACATTTTTCCCCCCGAA
CCCTCCATGAAGATCATCGCCGACATCTTCGAGTACACCGCCAAGCACATGCCCAAGTT
CAACTCCATCAGTATTAGCGGCTATCACATGCAGGAGGCCGGCGCCGACGCCATCCTGG
AACTGGCCTACACACTGGCCGACGGTCTGGAGTACAGCAGAACCGGCCTGCAAGCAGGC
CTGACCATCGACGAGTTCGCCCCTCGACTGAGCTTCTTCTGGGGCATTGGCATGAACTT
TTACATGGAGATCGCCAAAATGCGCGCTGGCAGGCGACTCTGGGCCCACCTGATAGAAA
AAATGTTCCAGCCCAAGAACTCCAAGTCCCTGCTCCTCAGGGCCCACTGTCAGACTAGC
GGCTGGAGCCTCACCGAGCAGGACCCATATAATAACATTGTAAGAACAGCCATCGAGGC
CATGGCCGCAGTGTTCGGAGGGACCCAGAGCCTGCATACCAACAGCTTCGATGAGGCCC
TGGGACTGCCCACTGTAAAGTCCGCTAGAATAGCCCGGAACACCCAGATCATTATCCAG
GAAGAGTCCGGGATCCCCAAGGTGGCCGACCCATGGGGCGGCAGCTACATGATGGAGTG
TCTCACCAACGACGTTTACGATGCTGCCCTGAAGCTTATCAACGAAATCGAGGAGATGG
GCGGCATGGCCAAAGCCGTCGCCGAGGGGATTCCAAAGCTCCGGATCGAGGAGTGCGCC
GCCAGAAGGCAGGCCAGAATCGACTCTGGAAGCGAGGTGATTGTGGGTGTGAATAAGTA
TCAGCTTGAGAAGGAAGACGCTGTAGAGGTGCTGGCTATAGATAACACCAGCGTCAGGA
ACAGGCAGATTGAAAAGCTGAAGAAGATCAAGTCGAGCAGAGATCAGGCGCTGGCCGAG
AGATGCCTGGCCGCCCTGACTGAGTGCGCCGCCTCTGGCGATGGCAACATCCTCGCACT
GGCCGTGGACGCTAGCCGGGCCCGGTGTACCGTGGGCGAGATAACCGATGCCCTGAAGA
AGGTGTTCGGAGAGCACAAGGCCAACGACAGAATGGTGTCTGGCGCATATAGACAGGAG
TTCGGCGAGAGCAAGGAGATTACGAGCGCCATCAAGAGAGTGCACAAGTTCATGGAGAG
GGAGGGCAGGAGACCACGGCTGCTGGTTGCCAAGATGGGCCAAGACGGTCACGACAGAG
GGGCTAAAGTGATTGCCACCGGCTTCGCCGACCTGGGCTTCGACGTGGACATCGGTCCA
CTGTTCCAGACCCCTAGGGAGGTGGCGCAGCAGGCCGTGGACGCCGACGTGCACGCCGT
CGGCGTGAGCACACTGGCTGCCGGCCACAAGACACTAGTTCCTGAGCTGATCAAGGAAC
TCAACAGCCTGGGCCGGCCTGATATACTGGTGATGTGCGGGGGGTGATCCCCCCTCAG
GATTACGAGTTTCTGTTTGAGGTGGGCGTGTCCAACGTCTTCGGCCCCGGGACCAGAAT
CCCAAAGGCCGCAGTGCAGGTATTAGACGACATTGAGAAGTGCCTGGAGAAGAAACAGC
AGTCCGTT
```

SEQ ID NO: 154

POLYNUCLEOTIDES ENCODING METHYLMALONYL-COA MUTASE

BACKGROUND OF THE DISCLOSURE

Methylmalonic acidemia (MMA) is a metabolic disorder characterized by the abnormal buildup of the metabolic byproduct methylmalonic acid in patients. MMA causes developmental delay, intellectual disability, kidney disease, coma, or even death. MMA is also referred to as methylmalonic aciduria. It has an estimated incidence of 1 in 50,000 to 100,000. Current treatment for MMA is primarily via dietary control to limit the usage of metabolic pathways that lead to methylmalonic acid formation. In serious cases, kidney and liver transplants have also been performed to provide a new reservoir of cells that can properly metabolize and remove the methylmalonic acid. However, none of these treatments completely or reliably controls the disorder. As such there is a need for improved therapy to treat MMA.

The principal gene associated with MMA is methylmalonyl-CoA mutase (NM 000255; NP 000246; also referred to as MCM or MUT). MCM is a metabolic enzyme (E.C. 5.4.99.2) that plays a critical role in the catabolism of various amino acids, fatty acids, and cholesterol. MCM's biological function is to isomerize L-methylmalonyl-CoA into succinyl-CoA, a Krebs cycle intermediate. MCM localizes to the mitochondria of cells, exists as a homodimer in its native form and is adenosylcobalamin-dependent. The precursor form of human MCM is 750 amino acids, while its mature form is 718 amino acids—a 32 amino acid leader sequence is cleaved off by mitochondrial importation and processing machinery. This leader sequence is variously referred to as MCM's mitochondrial targeting peptide, mitochondrial targeting sequence, or mitochondrial transit peptide.

A complete or partial loss of MCM function leads to buildup of abnormal metabolites and metabolic intermediates upstream of MCM, such as methylmalonic acid, propionyl-carnitine, acetyl-carnitine, propionyl-CoA, D-methylmalonyl-CoA and L-methylmalonyl-CoA. For example, loss of MCM has been reported to lead to a 1000-fold increase in the methylmalonic acid. Nonetheless, there is no currently available therapeutic to treat MMA.

SUMMARY OF THE DISCLOSURE

The present disclosure provides methods of treating methylmalonic acidemia in a subject, the methods comprising administering to the subject an effective amount of a polynucleotide comprising an mRNA encoding an MCM polypeptide, wherein the administration alleviates the symptoms of methylmalonic acidemia in the subject. The present disclosure also provides compositions comprising a polynucleotide sequence encoding an MCM polypeptide. In some embodiments, the compositions include a delivery agent.

In some embodiments, the composition comprises a polynucleotide that comprises an open reading frame (ORF) encoding an MCM polypeptide and a delivery agent, wherein the delivery agent comprises a compound having the formula (I)

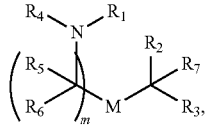

(I)

or a salt or stereoisomer thereof, wherein
$R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3-6}$ carbocycle, —(CH$_2$)$_n$Q, —(CH$_2$)$_n$CHQR,
—CHQR, —CQ(R)$_2$, and unsubstituted $C_{1-6}$ alkyl, where Q is selected from a carbocycle, heterocycle,
—OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, and —C(R)N(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—,
—N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13; and provided when $R_4$ is —(CH$_2$)$_n$Q, —(CH$_2$)$_n$CHQR, —CHQR, or —CQ(R)$_2$, then (i) Q is not —N(R)$_2$ when n is 1, 2, 3, 4 or 5, or (ii) Q is not 5, 6, or 7-membered heterocycloalkyl when n is 1 or 2.

In some embodiments, the delivery agent further comprises a phospholipid, a structural lipid, a PEG lipid, or any combination thereof.

In some embodiments, the polynucleotides comprise an ORF having significant sequence similarity to a polynucleotide selected from the group of SEQ ID NOs: 1-207, 732-765, and 772, wherein the ORF encodes an MCM polypeptide. In some embodiments, the polynucleotides comprise an ORF having significant sequence similarity to a polynucleotide selected from the group of SEQ ID NOs: 151, 152, 153, 154, 732, 733, and 734 (FIGS. 9-15), wherein the ORF encodes an MCM polypeptide. In some embodiments, the polynucleotide comprises an ORF having significant sequence similarity to SEQ ID NO: 734 (FIG. 11), wherein the ORF encodes an MCM polypeptide.

In some embodiments, the disclosure is directed to a polynucleotide comprising an ORF having at least 99% or 100% sequence identity to nucleotide 97 to nucleotide 2250 of SEQ ID NO: 734, wherein the ORF encodes an MCM polypeptide.

In some embodiments, the disclosure is directed to a polynucleotide comprising an ORF sequence having at least 98%, at least 99%, or 100% sequence identity to nucleotide 97 to nucleotide 2250 of SEQ ID NO: 732, wherein the ORF encodes an MCM polypeptide.

In some embodiments, the disclosure is directed to a polynucleotide comprising an ORF having at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 182, 733, and 741, wherein the ORF encodes an MCM polypeptide.

In some embodiments, the disclosure is directed to a polynucleotide comprising an ORF having at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 735, 736, 738, 743, 744, 748, 749, 750, 754, 755, 758, 762, and 765, wherein the ORF encodes an MCM polypeptide.

In some embodiments, the disclosure is directed to a polynucleotide comprising an ORF sequence having at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 180, 187, 737, 739, 740, 742, 745, 746, 747, 751, 752, 753, 757, 759, 760, 761, 763, and 764, wherein the ORF encodes an MCM polypeptide.

In some embodiments, the disclosure is directed to a polynucleotide comprising an ORF having at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 181 and 756, wherein the ORF encodes an MCM polypeptide.

In some embodiments, the disclosure is directed to a polynucleotide comprising an ORF having at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 154, 165, 171, 173, and 175, wherein the ORF encodes an MCM polypeptide.

In some embodiments, the disclosure is directed to a polynucleotide comprising an ORF having at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 151, 152, 153, 163, 164, 166, 167, 168, 169, 170, 172, 177, 178, 179, 195, and 204, wherein the ORF encodes an MCM polypeptide.

In some embodiments, the disclosure is directed to a polynucleotide comprising an ORF having at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 156, 157, 158, 159, 160, 161, 162, 174 and 176, wherein the ORF encodes an MCM polypeptide.

In some embodiments, the disclosure is directed to a polynucleotide comprising an ORF having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 155 and 203, wherein the ORF encodes an MCM polypeptide.

In some embodiments, the disclosure is directed to a polynucleotide comprising an ORF having at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 64, 66, 71, 91, and 128, wherein the ORF encodes an MCM polypeptide.

In some embodiments, the disclosure is directed to a polynucleotide comprising an ORF having at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 9, 11, 18, 19, 21, 22, 23, 24, 32, 33, 37, 39, 40, 44, 45, 47, 50, 51, 52, 55, 57, 61, 65, 70, 79, 84, 86, 88, 90, 92, 98, 100, 115, 117, 126, 129, 135, 136, 137, 144, 148, 150, 184, 190, 191, and 206, wherein the ORF encodes an MCM polypeptide.

In some embodiments, the disclosure is directed to a polynucleotide comprising an ORF having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 3, 5, 6, 8, 10, 12, 14, 16, 17, 20, 27, 28, 29, 31, 34, 35, 36, 38, 41, 42, 43, 46, 48, 49, 53, 54, 56, 58, 60, 63, 68, 69, 74, 77, 78, 80, 83, 85, 87, 93, 95, 96, 97, 99, 102, 103, 104, 105, 107, 110, 112, 113, 114, 116, 119, 120, 122, 123, 124, 125, 127, 131, 132, 133, 134, 138, 139, 140, 141, 142, 143, 147, 149, 183, 186, 188, 189, 192, 193, 194, 196, 197, 198, 199, 200, 201, 202, 205, and 207, wherein the ORF encodes an MCM polypeptide.

In some embodiments, the disclosure is directed to a polynucleotide comprising an ORF having at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 1, 2, 4, 7, 13, 15, 25, 26, 30, 59, 62, 67, 72, 73, 75, 76, 81, 82, 89, 94, 101, 106, 108, 109, 111, 118, 121, 130, 145, 146, and 185, wherein the ORF encodes an MCM polypeptide.

In some embodiments, the polynucleotides further comprise a nucleotide sequence encoding a transit peptide, e.g., mitochondrial transit peptide. The mitochondrial transit peptide can be any peptide that facilitates the transport of MCM to mitochondria or localization of MCM in mitochondria. In some embodiments, the polynucleotide comprises a nucleotide sequence encoding a mitochondrial transit peptide selected from the group listed in Table 1 (SEQ ID NOs: 251 to 265). In some embodiments, the polynucleotide comprises a nucleotide sequence encoding a mitochondrial transit peptide selected from the group consisting of SEQ ID NOs: 270 to 719.

In some embodiments, the disclosure is directed to a polynucleotide comprising an ORF having at least 99% or 100% sequence identity to nucleotide 1 to nucleotide 2250 of SEQ ID NO: 734, wherein the ORF encodes an MCM polypeptide.

In some embodiments, the disclosure is directed to a polynucleotide comprising an ORF having at least 98%, at least 99%, or 100% sequence identity to nucleotide 1 to nucleotide 2250 of SEQ ID NO: 732, wherein the ORF encodes an MCM polypeptide.

In some embodiments, the disclosure is directed to a polynucleotide comprising an ORF having at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 182 and 733, wherein the ORF encodes an MCM polypeptide.

In some embodiments, the disclosure is directed to a polynucleotide comprising an ORF having at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 735, 741, 743, 744, 748, 758, 762, and 765, wherein the ORF encodes an MCM polypeptide.

In some embodiments, the disclosure is directed to a polynucleotide comprising an ORF having at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 180, 181, 736, 738, 739, 740, 742, 746, 747, 749, 750, 751, 752, 753, 754, 755, 757, 759, 760, 761, and 763, wherein the ORF encodes an MCM polypeptide.

In some embodiments, the disclosure is directed to a polynucleotide comprising an ORF having at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 745, 756, and 764, wherein the ORF encodes an MCM polypeptide.

In some embodiments, the disclosure is directed to a polynucleotide comprising an ORF having at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 154, 165, 171, 173, and 175, wherein the ORF encodes an MCM polypeptide.

In some embodiments, the disclosure is directed to a polynucleotide comprising an ORF having at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 151, 152, 153, 163, 166, 167, 168, 169, 170, 172, 177, 178, 179, 187, and 204, wherein the ORF encodes an MCM polypeptide.

In some embodiments, the disclosure is directed to a polynucleotide comprising an ORF having at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 156, 157, 158, 159, 160, 162, 164, 174, 176, 195, and 737, wherein the ORF encodes an MCM polypeptide.

In some embodiments, the disclosure is directed to a polynucleotide comprising an ORF having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 155, 161, and 203, wherein the ORF encodes an MCM polypeptide.

In some embodiments, the disclosure is directed to a polynucleotide comprising an ORF having at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 71 and 128, wherein the ORF encodes an MCM polypeptide.

In some embodiments, the disclosure is directed to a polynucleotide comprising an ORF having at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 4, 6, 8, 9, 11, 19, 22, 23, 24, 32, 33, 37, 40, 44, 45, 47, 51, 61, 64, 65, 66, 79, 84, 86, 90, 91, 92, 100, 101, 112, 115, 117, 126, 129, 135, 136, 146, 148, 184, 190, and 191, wherein the ORF encodes an MCM polypeptide.

In some embodiments, the disclosure is directed to a polynucleotide comprising an ORF having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 2, 3, 5, 7, 10, 12, 13, 14, 15, 16, 18, 20, 21, 26, 27, 28, 29, 31, 34, 36, 38, 39, 41, 42, 43, 46, 48, 49, 52, 53, 54, 55, 56, 57, 58, 59, 60, 62, 68, 69, 70, 72, 73, 74, 76, 77, 80, 83, 85, 88, 95, 96, 97, 98, 102, 104, 105, 106, 107, 108, 109, 110, 113, 114, 120, 121, 122, 123, 124, 127, 131, 132, 133, 134, 137, 138, 139, 140, 141, 142, 144, 145, 147, 149, 150, 186, 188, 189, 192, 193, 194, 196, 198, 199, 200, 202, 205, 206, and 207, wherein the ORF encodes an MCM polypeptide.

In some embodiments, the disclosure is directed to a polynucleotide comprising an ORF having at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 1, 17, 25, 30, 35, 50, 63, 67, 75, 78, 81, 82, 87, 89, 93, 94, 99, 103, 111, 116, 118, 119, 125, 130, 143, 183, 185, 197, and 201, wherein the ORF encodes an MCM polypeptide.

In some embodiments, the disclosure is directed to polynucleotides that encode functional MCMs or fragments thereof. In some embodiments, the disclosure provides polynucleotides that encode functional human MCMs (SEQ ID NO: 208, SEQ ID NO: 209, SEQ ID NO: 210, SEQ ID NO: 211, SEQ ID NO: 212, and SEQ ID NO: 213). In some embodiments, the disclosure provides polynucleotides that encode functional MCM polypeptides having at least one point mutation in the MCM sequence, while still retaining MCM enzymatic activity. In some embodiments, the encoded MCM polypeptide comprises one or more of the point mutations V69, T499, H532, A598, and V671, as defined by the polypeptide sequences in SEQ ID NO: 209, SEQ ID NO: 210, SEQ ID NO: 211, SEQ ID NO: 212, and SEQ ID NO: 213, respectively. In some embodiments, the polynucleotides are fully or partially modified (e.g., chemically and/or structurally) in a manner as to avoid the deficiencies of other molecules of the art. The polynucleotides of the disclosure can be synthesized as an IVT polynucleotide, chimeric polynucleotide or a circular polynucleotide and such embodiments are contemplated.

In some embodiments, the polynucleotide is a DNA or RNA that comprises at least one chemically modified nucleoside. In some embodiments, the at least one chemically modified nucleoside is selected from any of those described herein.

In some embodiments, the polynucleotide further comprises or encodes a 5' UTR. In other embodiments, the polynucleotide further comprises or encodes a 3' UTR. In some embodiments, the UTR comprises or encodes a miRNA (e.g., miR-142-3p, miR-142-5p, miR-126-3p, and/or miR-126-5p). In some embodiments, the polynucleotide further comprises a 5' terminal cap. In some embodiments, the polynucleotide further comprises or encodes a 3' polyA tail.

In some embodiments, the polynucleotide is RNA, e.g., mRNA. In some embodiments, the mRNA comprises the sequences listed in SEQ ID NOs: 766-771.

In some embodiments, the polynucleotide is an RNA polynucleotide that is formulated in a lipid nanoparticle (LNP) carrier.

The disclosure is also directed to a method of treating methylmalonic acidemia in a subject, the method comprising administering to the subject an effective amount of a polynucleotide comprising an mRNA encoding an MCM polypeptide, wherein the administration alleviates the symptoms of methylmalonic acidemia in the subject. In some embodiments, the polynucleotide useful for the disclosure is any one of the polynucleotides encoding an MCM polypeptide described herein or is formulated as any one of the compositions described herein.

In some embodiments, the disclosure includes a method of reducing the level of a metabolite associated with methylmalonic acidemia in a subject in need thereof, the method comprising administering to the subject an effective amount of a polynucleotide comprising an mRNA encoding an MCM polypeptide. In some embodiments, the polynucleotide is a polynucleotide described elsewhere herein, or is formulated as a composition described herein. In certain embodiments, the polynucleotide reduces the level of methylmalonic acid present in the subject after the administration by at least about 10%, at least about 20%, at least about 30%, at least about 40%, at least about 50%, at least about 60%, at least about 70%, at least about 80%, at least about 90%, or about 100%. In other embodiments, after the administration, the polynucleotide reduces the level of propionyl-carnitine present in the subject by at least about 10%, at least about 20%, at least about 30%, at least about 40%, at least about 50%, at least about 60%, at least about 70%, at least about 80%, at least about 90%, or about 100%. In yet other embodiments, the polynucleotide reduces the level of acetyl-carnitine present in the subject after the administration by at least about 10%, at least about 20%, at least about 30%, at least about 40%, at least about 50%, at least about 60%, at least about 70%, at least about 80%, at least about 90%, or about 100%. In certain embodiments, one or more metabolites associated with methylmalonic acidemia are reduced after the administration within one day, within two days, within three days, within four days, within five days, within seven days, within one week, within two weeks, within three weeks, or within one month of the administration of the polynucleotide.

The details of various embodiments of the disclosure are set forth in the description below. Other features, objects, and advantages of the disclosure will be apparent from the description and the drawings, and from the claims.

EMBODIMENTS

E1. A composition comprising a polynucleotide that comprises an open reading frame (ORF) encoding an MCM polypeptide and a delivery agent, wherein the delivery agent comprises a compound having the formula (I)

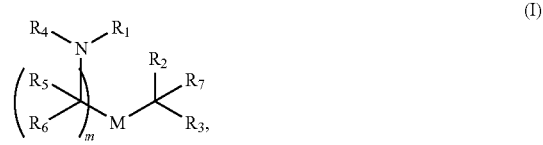

or a salt or stereoisomer thereof, wherein $R_1$ is selected from the group consisting of $C_{5\text{-}20}$ alkyl, $C_{5\text{-}20}$ alkenyl, —R*YR", —YR", and —R"M'R'

$R_2$ and $R_3$ are independently selected from the group consisting of H, $C_{1\text{-}14}$ alkyl, $C_{2\text{-}14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3\text{-}6}$ carbocycle, —(CH$_2$)$_n$Q, —(CH$_2$)$_n$CHQR,
—CHQR, —CQ(R)$_2$, and unsubstituted $C_{1\text{-}6}$ alkyl, where Q is selected from a carbocycle, heterocycle,
—OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, and —C(R)N(R)$_2$C(O)OR, and each n is independently selected from 1, 2, 3, 4, and 5;

each $R_5$ is independently selected from the group consisting of $C_{1\text{-}3}$ alkyl, $C_{2\text{-}3}$ alkenyl, and H;

each $R_6$ is independently selected from the group consisting of $C_{1\text{-}3}$ alkyl, $C_{2\text{-}3}$ alkenyl, and H;

M and M' are independently selected from —C(O)O—, —OC(O)—, —C(O)N(R')—,
—N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1\text{-}3}$ alkyl, $C_{2\text{-}3}$ alkenyl, and H;

each R is independently selected from the group consisting of $C_{1\text{-}3}$ alkyl, $C_{2\text{-}3}$ alkenyl, and H;

each R' is independently selected from the group consisting of $C_{1\text{-}18}$ alkyl, $C_{2\text{-}18}$ alkenyl, —R*YR", —YR", and H;

each R" is independently selected from the group consisting of $C_{3\text{-}14}$ alkyl and $C_{3\text{-}14}$ alkenyl;

each R* is independently selected from the group consisting of $C_{1\text{-}12}$ alkyl and $C_{2\text{-}12}$ alkenyl;

each Y is independently a $C_{3\text{-}6}$ carbocycle;

each X is independently selected from the group consisting of F, Cl, Br, and I; and m is selected from 5, 6, 7, 8, 9, 10, 11, 12, and 13; and provided when $R_4$ is —$(CH_2)_nQ$, —$(CH_2)_n$CHQR, —CHQR, or —$CQ(R)_2$, then (i) Q is not —$N(R)_2$ when n is 1, 2, 3, 4 or 5, or (ii) Q is not 5, 6, or 7-membered heterocycloalkyl when n is 1 or 2.

E2. The composition of embodiment 1, wherein the ORF has at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 1 to 207, 732 to 765, and 772.

E3. The composition of embodiment 1 or 2, wherein the ORF has (i) at least 99% or 100% sequence identity to nucleotide 97 to nucleotide 2250 of SEQ ID NO: 734, (ii) at least 98%, at least 99%, or 100% sequence identity to nucleotide 97 to nucleotide 2250 of SEQ ID NO: 732, (iii) at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 182, 733, and 741;

(iv) at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 735, 736, 738, 743, 744, 748, 749, 750, 754, 755, 758, 762, and 765;

(v) at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 180, 187, 737, 739, 740, 742, 745, 746, 747, 751, 752, 753, 757, 759, 760, 761, 763, and 764;

(vi) at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 181 and 756;

(vii) at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 154, 165, 171, 173, and 175;

(viii) at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 151, 152, 153, 163, 164, 166, 167, 168, 169, 170, 172, 177, 178, 179, 195, and 204;

(ix) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 156, 157, 158, 159, 160, 161, 162, 174 and 176;

(x) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 155 and 203;

(xi) at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 64, 66, 71, 91, and 128;

(xii) at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 9, 11, 18, 19, 21, 22, 23, 24, 32, 33, 37, 39, 40, 44, 45, 47, 50, 51, 52, 55, 57, 61, 65, 70, 79, 84, 86, 88, 90, 92, 98, 100, 115, 117, 126, 129, 135, 136, 137, 144, 148, 150, 184, 190, 191, and 206;

(xiii) at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 3, 5, 6, 8, 10, 12, 14, 16, 17, 20, 27, 28, 29, 31, 34, 35, 36, 38, 41, 42, 43, 46, 48, 49, 53, 54, 56, 58, 60, 63, 68, 69, 74, 77, 78, 80, 83, 85, 87, 93, 95, 96, 97, 99, 102, 103, 104, 105, 107, 110, 112, 113, 114, 116, 119, 120, 122, 123, 124, 125, 127, 131, 132, 133, 134, 138, 139, 140, 141, 142, 143, 147, 149, 183, 186, 188, 189, 192, 193, 194, 196, 197, 198, 199, 200, 201, 202, 205, and 207; or (xiv) at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 1, 2, 4, 7, 13, 15, 25, 26, 30, 59, 62, 67, 72, 73, 75, 76, 81, 82, 89, 94, 101, 106, 108, 109, 111, 118, 121, 130, 145, 146, and 185.

E4. The composition of any one of embodiments 1 to 3, wherein the ORF further comprises a nucleic acid sequence encoding a transit peptide.

E5. The composition of embodiment 4, wherein the transit peptide comprises a mitochondrial transit peptide.

E6. The composition of embodiment 5, wherein the mitochondrial transit peptide is derived from a protein selected from the group consisting of SEQ ID NOs: 251 to 265 and 270 to 719.

E7. The composition of any one of embodiments 4 to 6, wherein the nucleic acid sequence encoding a transit peptide has at least about 70%, at least about 80%, at least about 90%, at least about 95%, at least about 96%, at least about 97%, at least about 98%, at least about 99%, or about 100% sequence identity to a sequence selected from the group consisting of nucleotides 1 to 96 of SEQ ID NOs: 1 to 207, 732 to 765, and 772.

E8. The composition of any one of embodiments 1 to 7, wherein the ORF has (i) at least 99% or 100% sequence identity to nucleotide 1 to nucleotide 2250 of SEQ ID NO: 734;

(ii) at least 98%, at least 99%, or 100% sequence identity to nucleotide 1 to nucleotide 2250 of SEQ ID NO: 732;

(iii) at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 182 and 733;

(iv) at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 735, 741, 743, 744, 748, 758, 762, and 765;

(v) at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 180, 181, 736, 738, 739, 740, 742, 746, 747, 749, 750, 751, 752, 753, 754, 755, 757, 759, 760, 761, and 763;

(vi) at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 745, 756, and 764;

(vii) at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 154, 165, 171, 173, and 175;

(viii) at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 151, 152, 153, 163, 166, 167, 168, 169, 170, 172, 177, 178, 179, 187, and 204;

(ix) at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 156, 157, 158, 159, 160, 162, 164, 174, 176, 195, and 737;

(x) at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 155, 161, and 203;

(xi) at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 71 and 128;

(xii) at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 4, 6, 8, 9, 11, 19, 22, 23, 24, 32, 33, 37, 40, 44, 45, 47, 51, 61, 64, 65, 66, 79, 84, 86, 90, 91, 92, 100, 101, 112, 115, 117, 126, 129, 135, 136, 146, 148, 184, 190, and 191;

(xiii) at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 2, 3, 5, 7, 10, 12, 13, 14, 15, 16, 18, 20, 21, 26, 27, 28, 29, 31, 34, 36, 38, 39, 41, 42, 43, 46, 48, 49, 52, 53, 54, 55, 56, 57, 58, 59, 60, 62, 68, 69, 70, 72, 73, 74, 76, 77, 80, 83, 85, 88, 95, 96, 97, 98, 102, 104, 105, 106, 107, 108, 109, 110, 113, 114, 120, 121, 122, 123, 124, 127, 131, 132, 133, 134, 137, 138, 139, 140, 141, 142, 144, 145, 147, 149, 150, 186, 188, 189, 192, 193, 194, 196, 198, 199, 200, 202, 205, 206, and 207; or (xiv) at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 1, 17, 25, 30, 35, 50, 63, 67, 75, 78, 81, 82, 87, 89, 93, 94, 99, 103, 111, 116, 118, 119, 125, 130, 143, 183, 185, 197, and 201.

E9. The composition of any one of embodiments 1 to 8, wherein the MCM polypeptide comprises an amino acid sequence at least about 95%, at least about 96%, at least about 97%, at least about 98%, at least about 99%, or about 100% identical to SEQ ID NO: 208, and wherein the MCM polypeptide retains methylmalonyl-CoA mutase activity.

E10. The composition of embodiment 9, wherein the MCM polypeptide comprises SEQ ID NO: 209.

E11. The composition of embodiment 9, wherein the MCM polypeptide comprises SEQ ID NO: 210.

E12. The composition of embodiment 9, wherein the MCM polypeptide comprises SEQ ID NO: 211.

E13. The composition of embodiment 9, wherein the MCM polypeptide comprises SEQ ID NO: 212.

E14. The composition of embodiment 9, wherein the MCM polypeptide comprises SEQ ID NO: 213.

E15. The composition of any one of embodiments 1-14, wherein the polynucleotide comprises at least one chemically modified nucleobase, sugar, backbone, or any combination thereof.

E16. The composition of embodiment 15, wherein the at least one chemically modified nucleobase is selected from the group consisting of pseudouracil (ψ), N1-methylpseudouracil (m1ψ), 2-thiouracil (s2U), 4'-thiouracil, 5-methylcytosine, 5-methyluracil, and any combination thereof.

E17. The composition of embodiment 16, wherein the at least one chemically modified nucleoside is 5-methoxyuracil.

E18. The composition of any one of embodiments 1-17, wherein the nucleosides in the polynucleotide sequence are chemically modified by at least 10%, at least 20%, at least 30%, at least 40%, at least 50%, at least 60%, at least 70%, at least 80%, at least 90%, at least 95%, at least 99%, or 100%.

E19. The composition of any one of embodiments 15-18, wherein the chemically modified nucleosides in the polynucleotide sequence are selected from the group consisting of uridine, adenine, cytosine, guanine, and any combination thereof.

E20. The composition of any one of embodiments 1-19, wherein the uridine nucleosides in the polynucleotide sequence are chemically modified by at least 10%, at least 20%, at least 30%, at least 40%, at least 50%, at least 60%, at least 70%, at least 80%, at least 90%, at least 95%, at least 99%, or 100%.

E21. The composition of any one of embodiments 1-20, wherein the adenine nucleosides in the polynucleotide sequence are chemically modified by at least 10%, at least 20%, at least 30%, at least 40%, at least 50%, at least 60%, at least 70%, at least 80%, at least 90%, at least 95%, at least 99%, or 100%.

E22. The composition of any one of embodiments 1-21, wherein the cytosine nucleosides in the polynucleotide sequence are chemically modified by at least at least 10%, at least 20%, at least 30%, at least 40%, at least 50%, at least 60%, at least 70%, at least 80%, at least 90%, at least 95%, at least 99%, or 100%.

E23. The composition of any one of embodiments 1-22, wherein the guanine nucleosides in the polynucleotide sequence are chemically modified by at least at least 10%, at least 20%, at least 30%, at least 40%, at least 50%, at least 60%, at least 70%, at least 80%, at least 90%, at least 95%, at least 99%, or 100%.

E24. The composition of any one of embodiments 1-23, wherein the polynucleotide further comprises a 5' UTR.

E25. The composition of embodiment 24, wherein the 5' UTR comprises a nucleic acid sequence at least 90%, 95%, 96%, 97%, 98%, 99%, or 100% identical to a sequence selected from SEQ ID NOs: 215-231, 266, and 725-731.

E26. The composition of any one of embodiments 1 to 25, wherein the polynucleotide further comprises a miRNA binding site.

E27. The composition of embodiment 26, wherein the miRNA binding site comprises one or more polynucleotide sequences selected SEQ ID NOs: 720, 721, 722, 723, and 724.

E28. The composition of embodiment 26, wherein the miRNA binding site binds to miR-142 or miR-126.

E29. The composition of embodiment 26, wherein the miRNA binding site binds to miR-142-3p, miR-142-5p, miR-126-3p, or miR-126-5p.

E30. The composition of embodiment 24, wherein the 5'UTR comprises a sequence selected from SEQ ID NOs: 725, 726, 727, 728, 729, 730, and 731.

E31. The composition of any one of embodiments 24-30, wherein the 5' UTR is sequence optimized.

E32. The composition of any one of embodiments 1-31, wherein the polynucleotide further comprises a 3' UTR.

E33. The composition of embodiment 32, wherein the 3' UTR comprises a nucleic acid sequence at least 90%, 95%, 96%, 97%, 98%, 99%, or 100% identical to a sequence selected from SEQ ID NO: 232-248 and 267.

E34. The composition of embodiment 32 or 33, wherein the 3' UTR is codon optimized.

E35. The composition of any one of embodiments 1-34, wherein the polynucleotide further comprises a 5' terminal cap.

E36. The composition of embodiment 35, wherein the 5' terminal cap is a Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2, Cap4, 5' methylG cap, or an analog thereof.

E37. The composition of any one of embodiments 1-36, wherein the polynucleotide further comprises a 3' polyA tail.

E38. The composition of any one of embodiments 1-37, wherein the polynucleotide is RNA.

E39. The composition of embodiment 38, wherein the RNA is mRNA.

E40. The composition of any one of embodiments 1-39, wherein the polynucleotide is in vitro transcribed (IVT).

E41. The composition of any one of embodiments 1-40, wherein the polynucleotide is chimeric.

E42. The composition of any one of embodiments 1-41, wherein the polynucleotide is circular.

E43. The composition of any one of embodiments 1-42, wherein the polynucleotide is purified by strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

E44. The composition of any one of embodiments 1-43, wherein the compound is of Formula (IA):

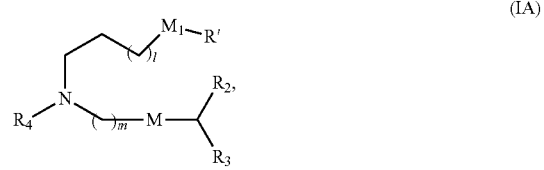

or a salt or stereoisomer thereof, wherein
l is selected from 1, 2, 3, 4, and 5;
m is selected from 5, 6, 7, 8, and 9;
$M_1$ is a bond or M';
$R_4$ is unsubstituted $C_{1-3}$ alkyl, or —$(CH_2)_nQ$, in which n is 1, 2, 3, 4, or 5 and Q is OH, —$NHC(S)N(R)_2$, or —$NHC(O)N(R)_2$;
M and M' are independently selected from C(O)O, OC(O), C(O)N(R'), P(O)(OR')O, an aryl group, and a heteroaryl group; and
$R_2$ and $R_3$ are independently selected from the group consisting of H, $C_{1-14}$ alkyl, and $C_{2-14}$ alkenyl.

E45. The composition of any one of embodiments 1 to 44, wherein m is 5, 7, or 9.

E46. The composition of any one of embodiments 1 to 45, wherein the compound is of Formula (II):

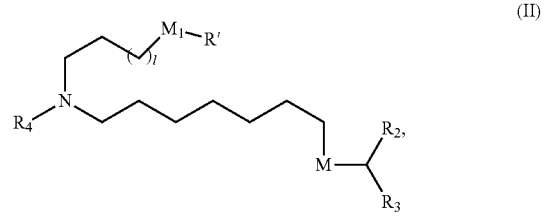

or a salt or stereoisomer thereof, wherein
l is selected from 1, 2, 3, 4, and 5;
$M_1$ is a bond or M';
$R_4$ is unsubstituted $C_{1-3}$ alkyl, or —$(CH_2)_nQ$, in which n is 2, 3, or 4 and Q is OH, —$NHC(S)N(R)_2$, or —$NHC(O)N(R)_2$;
M and M' are independently selected from —C(O)O, OC(O), C(O)N(R'), P(O)(OR')O, an aryl group, and a heteroaryl group; and
$R_2$ and $R_3$ are independently selected from the group consisting of H, $C_{1-14}$ alkyl, and $C_{2-14}$ alkenyl.

E47. The composition of any one of embodiments 44 to 46, wherein $M_1$ is M'.

E48. The composition of embodiment 47, wherein M and M' are independently —C(O)O— or —OC(O)—.

E49. The composition of any one of embodiments 44 to 48, wherein 1 is 1, 3, or 5.

E50. The composition of any one of embodiments 1 to 43, wherein the compound is selected from the group consisting of Compound 1 to Compound 147, salts and stereoisomers thereof, and any combination thereof.

E51. The composition of any one of embodiments 1 to 43, wherein the compound is of the Formula (IIa),

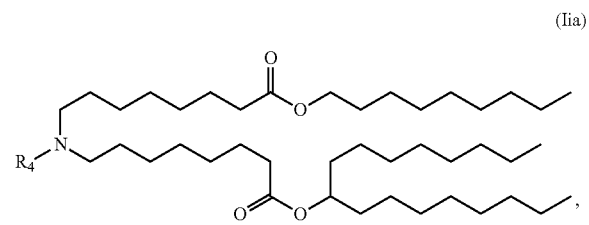
(IIa)

or a salt or stereoisomer thereof.

E52. The composition of any one of embodiments 1 to 43, wherein the compound is of the Formula (IIb),

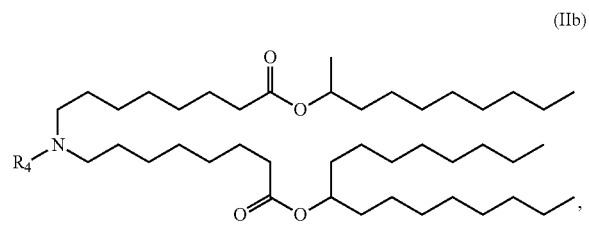
(IIb)

or a salt or stereoisomer thereof.

E53. The composition of any one of embodiments 1 to 43, wherein the compound is of the Formula (IIc) or (IIe),

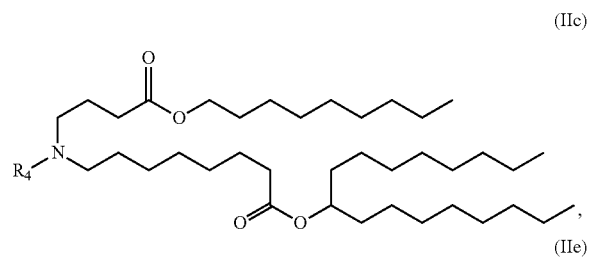
(IIc)

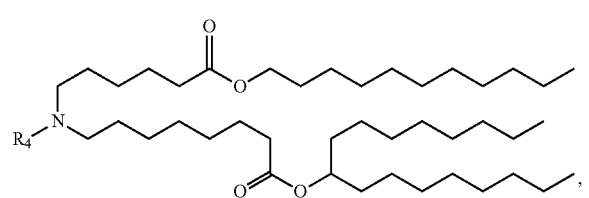
(IIe)

or a salt or stereoisomer thereof.

E54. The composition of any one of embodiments 51 to 53, wherein $R_4$ is selected from —$(CH_2)_nQ$ and —$(CH_2)_nCHQR$.

E55. The composition of any one of embodiments 1 to 43, wherein the compound is of the Formula (IId),

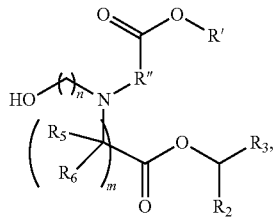
(IId)

or a salt or stereoisomer thereof,
wherein $R_2$ and $R_3$ are independently selected from the group consisting of $C_{5-14}$ alkyl and $C_{5-14}$ alkenyl, n is selected from 2, 3, and 4, and R', R'', $R_5$, $R_6$ and m are as defined in embodiment 1.

E56. The composition of embodiment 55, wherein $R_2$ is $C_8$ alkyl.

E57. The composition of embodiment 56, wherein $R_3$ is $C_5$ alkyl, $C_6$ alkyl, $C_7$ alkyl, $C_8$ alkyl, or $C_9$ alkyl.

E58. The composition of any one of embodiments 55 to 57, wherein m is 5, 7, or 9.

E59. The composition of any one of embodiments 55 to 58, wherein each $R_5$ is H.

E60. The composition of embodiment 59, wherein each $R_6$ is H.

E61. The composition of any one of embodiments 1 to 60, wherein the composition is a nanoparticle composition.

E62. The composition of embodiment 61, wherein the delivery agent further comprises a phospholipid.

E63. The composition of embodiment 62, wherein the phospholipid is selected from the group consisting of 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-distearoyl-sn-glycero-3-phosphocholine (DSPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-dioleoyl-sn-glycero-3-phosphoethanolamine (DOPE), 1,2-diphytanoyl-sn-glycero-3-phosphoethanolamine (ME 16:0 PE), 1,2-di stearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), sphingomyelin, and any mixtures thereof.

E64. The composition of any one of embodiments 1 to 63, wherein the delivery agent further comprises a structural lipid.

E65. The composition of embodiment 64, wherein the structural lipid is selected from the group consisting of cholesterol, fecosterol, sitosterol, ergosterol, campesterol, stigmasterol, brassicasterol, tomatidine, ursolic acid, alpha-tocopherol, and any mixtures thereof.

E66. The composition of any one of embodiments 1 to 65, wherein the delivery agent further comprises a PEG lipid.

E67. The composition of embodiment 66, wherein the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and any mixtures thereof.

E68. The composition of any one of embodiments 1 to 67, wherein the delivery agent further comprises an ionizable lipid selected from the group consisting of 3-(didodecylamino)-N1,N1,4-tridodecyl-1-piperazineethanamine (KL10), N1-[2-(didodecylamino)ethyl]-N1,N4,N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethylaminomethyl-[1,3]-dioxolane (DLin-K-DMA), heptatriaconta-6,9,28,31-tetraen-19-yl 4-(dimethylamino)butanoate (DLin-MC3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), 2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA), (2R)-2-({8-[(3β)-cholest-5-en-3-yloxy]octyl}xy)-N,N-dimethyl-3-[(9Z,12Z)-octadeca-9,12-dien-1-yloxy]propan-1-amine (Octyl-CLinDMA (2R)), and (2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)).

E69. The composition of any one of embodiments 1 to 68, wherein the delivery agent further comprises a phospholipid, a structural lipid, a PEG lipid, or any combination thereof.

E70. The composition of any one of embodiments 1-69, wherein the composition is formulated for in vivo delivery.

E71. The composition of embodiment 70 which is formulated for intramuscular, subcutaneous, or intradermal delivery.

E72. The composition of any one of embodiments 1-71 which increases cellular expression of MCM.

E73. The composition of embodiment 72, wherein the cellular expression of MCM is increased by at least 20%, at least 25%, at least 30%, at least 35%, at least 40%, at least 45%, or at least 50%.

E74. A method of administering the composition of any one of embodiments 1-73, wherein the administration alleviates the symptoms of methylmalonic acidemia in the subject.

E75. The method of embodiment 74, wherein the administration results in a reduction of the level of a metabolite associated with methylmalonic acidemia in a subject in need thereof.

E76. The method of embodiment 74 or 75, further comprising measuring the level of the metabolite in the subject or in a sample obtained from the subject before and/or after the administering.

E77. The method of embodiment 76, wherein the sample is taken from the subject's blood, urine, cerebrospinal fluid, or any combination thereof.

E78. The method of any of embodiments 74 to 77, wherein the administration reduces the level of methylmalonic acid present in the subject by at least about 10%, at least about 20%, at least about 30%, at least about 40%, at least about 50%, at least about 60%, at least about 70%, at least about 80%, at least about 90%, or about 100%.

E79. The method of any of embodiments 74 to 78, wherein the polynucleotide reduces the level of propionyl-carnitine present in the subject by at least about 10%, at least about 20%, at least about 30%, at least about 40%, at least about 50%, at least about 60%, at least about 70%, at least about 80%, at least about 90%, or about 100%.

E80. The method of any of embodiments 74 to 79, wherein the polynucleotide reduces the level of acetyl-carnitine present in the subject by at least about 10%, at least about 20%, at least about 30%, at least about 40%, at least about 50%, at least about 60%, at least about 70%, at least about 80%, at least about 90%, or about 100%.

E81. The method of any one of embodiments 74 to 80, wherein one or more metabolites associated with methylmalonic acidemia are reduced within one day, within two days, within three days, within four days, within five days, within seven days, within one week, within two weeks, within three weeks, or within one month of the administration of the polynucleotide.

E82. A method of treating methylmalonic acidemia in a subject in need thereof, the method comprising administering to the subject an effective amount of a polynucleotide comprising an mRNA that comprises an ORF encoding an MCM polypeptide, wherein the administration alleviates the symptoms of methylmalonic acidemia in the subject.

E83. The method of embodiment 82, wherein the polynucleotide comprises the polynucleotide in the composition of any one of embodiments 1 to 73.

E84. The method of embodiment 82 or 83, wherein the administration reduces the level of a metabolite associated with methylmalonic acidemia in a subject in need thereof.

E85. The method of any one of embodiments 82-84, further comprising measuring the level of the metabolite in the subject or in a sample obtained from the subject before and/or after the administering.

E86. The method of embodiment 85, wherein the sample is taken from the subject's blood, urine, cerebrospinal fluid, or any combination thereof.

E87. The method of any of embodiments 82 to 86, wherein the polynucleotide reduces the level of methylmalonic acid present in the subject by at least about 10%, at least about 20%, at least about 30%, at least about 40%, at least about 50%, at least about 60%, at least about 70%, at least about 80%, at least about 90%, or about 100%.

E88. The method of any of embodiments 82 to 87, wherein the polynucleotide reduces the level of propionyl-carnitine present in the subject by at least about 10%, at least about 20%, at least about 30%, at least about 40%, at least about 50%, at least about 60%, at least about 70%, at least about 80%, at least about 90%, or about 100%.

E89. The method of any of embodiments 82 to 88, wherein the polynucleotide reduces the level of acetyl-carnitine present in the subject by at least about 10%, at least about 20%, at least about 30%, at least about 40%, at least about 50%, at least about 60%, at least about 70%, at least about 80%, at least about 90%, or about 100%.

E90. The method of any one of embodiments 82 to 89, wherein one or more metabolites associated with methylmalonic acidemia are reduced within one day, within two days, within three days, within four days, within five days, within seven days, within one week, within two weeks, within three weeks, or within one month of the administration of the polynucleotide.

E91. The method of any one of embodiments 82 to 90, wherein the nucleotide is administered as a nanoparticle composition.

E92. The method of embodiment 91, wherein the composition further comprises a delivery agent.

E93. The method of embodiment 92, wherein the delivery agent comprises a phospholipid.

E94. The method of embodiment 93, wherein the phospholipid is selected from the group consisting of 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-distearoyl-sn-glycero-3-phosphocholine (DSPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-dioleoyl-sn-glycero-3-phosphoethanolamine (DOPE), 1,2-diphytanoyl-sn-glycero-3-phosphoethanolamine (ME 16:0 PE), 1,2-di stearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), sphingomyelin, and any mixtures thereof.

E95. The method of any one of embodiments 92 to 94, wherein the delivery agent further comprises a structural lipid.

E96. The method of embodiment 95, wherein the structural lipid is selected from the group consisting of cholesterol, fecosterol, sitosterol, ergosterol, campesterol, stigmasterol, brassicasterol, tomatidine, ursolic acid, alpha-tocopherol, and any mixtures thereof.

E97. The method of any one of embodiments 92 to 96, wherein the delivery agent further comprises a PEG lipid.

E98. The method of embodiment 97, wherein the PEG lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and any mixtures thereof.

E99. The method of any one of embodiments 92 to 98, wherein the delivery agent further comprises an ionizable lipid selected from the group consisting of 3-(didodecylamino)-N1,N1,4-tridodecyl-1-piperazineethanamine (KL10), N1-[2-(didodecylamino)ethyl]-N1,N4,N4-tridodecyl-1,4-piperazinediethanamine (KL22), 14,25-ditridecyl-15,18,21,24-tetraaza-octatriacontane (KL25), 1,2-dilinoleyloxy-N,N-dimethylaminopropane (DLin-DMA), 2,2-dilinoleyl-4-dimethylaminomethyl-[1,3]-dioxolane (DLin-K-DMA), heptatriaconta-6,9,28,31-tetraen-19-yl 4-(dimethylamino)butanoate (DLin-MC3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), 2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA), (2R)-2-({8-[(3β)-cholest-5-en-3-yloxy]octyl}xy)-N,N-dimethyl-3-[(9Z,12Z)-octadeca-9,12-dien-1-yloxy]propan-1-amine (Octyl-CLinDMA (2R)), and (2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)).

E100. The method of any one of embodiments 92 to 99, wherein the delivery agent further comprises a phospholipid, a structural lipid, a PEG lipid, or any combination thereof.

E101. The method of any one of embodiments 92-100, wherein the composition is formulated for in vivo delivery.

E102. The method of embodiment 101 which is formulated for intramuscular, subcutaneous, or intradermal delivery.

E103. The method of any one of embodiments 82-102 which increases cellular expression of MCM.

E104. The method of embodiment 103, wherein the cellular expression of MCM is increased by at least 20%, at least 25%, at least 30%, at least 35%, at least 40%, at least 45%, or at least 50%.

E105. The method of any one of embodiments 74 to 104, wherein the polynucleotide is administered at a dose of 0.1 mg/kg to 1.0 mg/kg, 0.1 mg/kg to 10 mg/kg, 0.1 mg/kg to 2 mg/kg, 0.1 mg/kg to 5 mg/kg, 1 mg/kg to 5 mg/kg, or 1 mg/kg to 3 mg/kg.

E106. The method of any one of embodiments 74 to 105, wherein the plasma MMA level after the administration is reduced at least 70%, at least 75%, at least 80%, at least 85%, at least 90%, or at least 95% compared to the plasma MMA level prior to the administration.

E107. The method of embodiment 106, wherein the plasma MMA level is reduced about 75% to 85% compared to the plasma MMA level prior to the administration.

E108. The method of any one of embodiments 74 to 107, wherein the plasma MMA level after the administration is lower than about 5 µmol/L, about 4.5 µmol/L, about 4 µmol/L, about 3.5 µmol/L, about 3 µmol/L, about 2.5 µmol/L, about 2 µmol/L, about 1.5 µmol/L, about 1 µmol/L, about 0.9 µmol/L, about 0.8 µmol/L, about 0.7 µmol/L, about 0.6 µmol/L, about 0.5 µmol/L, about 0.4 µmol/L, about 0.3 µmol/L, or 0.27 µmol/L.

E109. The method of embodiments 74 to 108, wherein the urinary MMA level is less than 2000 mmol/mol creatinine, less than 1900 mmol/mol creatinine, less than 1800 mmol/mol creatinine, less than 1700 mmol/mol creatinine, less than 1600 mmol/mol creatinine, less than 1500 mmol/mol creatinine, less than 1400 mmol/mol creatinine, less than 1300 mmol/mol creatinine, less than 1200 mmol/mol creatinine, less than 1100 mmol/mol creatinine, less than 1000 mmol/mol creatinine, 900 mmol/mol creatinine, 800 mmol/mol creatinine, 700 mmol/mol creatinine, 600 mmol/mol creatinine, 500 mmol/mol creatinine, 400 mmol/mol creatinine, 300 mmol/mol creatinine, 200 mmol/mol creatinine, 100 mmol/mol creatinine, 90 mmol/mol creatinine, 80 mmol/mol creatinine, 70 mmol/mol creatinine, 60 mmol/mol creatinine, 50 mmol/mol creatinine, 40 mmol/mol creatinine, 30 mmol/mol creatinine, 20 mmol/mol creatinine, 10 mmol/mol creatinine, 9 mmol/mol creatinine, 8 mmol/mol creatinine, 7 mmol/mol creatinine, 6 mmol/mol creatinine, 5 mmol/mol creatinine, 4 mmol/mol creatinine, 3 mmol/mol creatinine, 2 mmol/mol creatinine, or 1 mmol/mol creatinine.

BRIEF DESCRIPTION OF THE DRAWINGS

FIG. 2A shows the location of mitochondria using Mitotracker and the nucleus using DAPI. FIG. 2B shows the immunostaining of hMCM protein using a murine monoclonal anti-MCM antibody and the location of the nucleus using DAPI.

FIG. 2C shows the merged picture of FIGS. 2A and 2B.

FIGS. 6A and 6C are images taken of patient fibroblasts transfected with mRNA encoding eGFP. FIGS. 6B and 6D are images taken of patient fibroblasts transfected with mRNA encoding hMCM.

FIGS. 9-15 show exemplary codon optimized MCM sequences that encode methylmalonyl-CoA mutase. The illustrated sequences in FIGS. 9-15 are SEQ ID NOs: 732, 733, 734, 151, 152, 153, and 154, respectively.

FIG. 16A shows plasma levels of methylmalonic acid (MMA) in µM measured by LC-MS/MS over time in mice treated weekly with control mRNA (NT-FIX) at 0.1 mg/kg, codon optimized MCM mRNA (encoding SEQ ID NO:734) formulated in lipid nanoparticles at 0.16 or 0.2 mg/kg for 5 injections, or codon optimized MCM mRNA (encoding SEQ ID NO:734) formulated in lipid nanoparticles at 0.2 mg/kg for 2 injections. FIG. 16B shows the body weight of the mice over time (measured twice a week). ***p<0.001; P-values obtained from repeated measures ANOVA. FIG. 16C shows the increase in body weight over time in mice injected weekly with codon optimized MCM mRNA.

FIG. 18A shows levels of lipid nanoparticles after single dose injection of codon optimized MCM mRNA. FIG. 18B shows Hepatic hMut mRNA levels in mouse liver after single dose injection of codon optimized MCM mRNA. FIG. 18C shows MCM protein levels after single dose injection of codon optimized MCM mRNA FIG. 19A shows a Western blot of expression after dosing with different formulations, and FIG. 19B shows a quantification of that Western blot.

DETAILED DESCRIPTION

Figure 1:
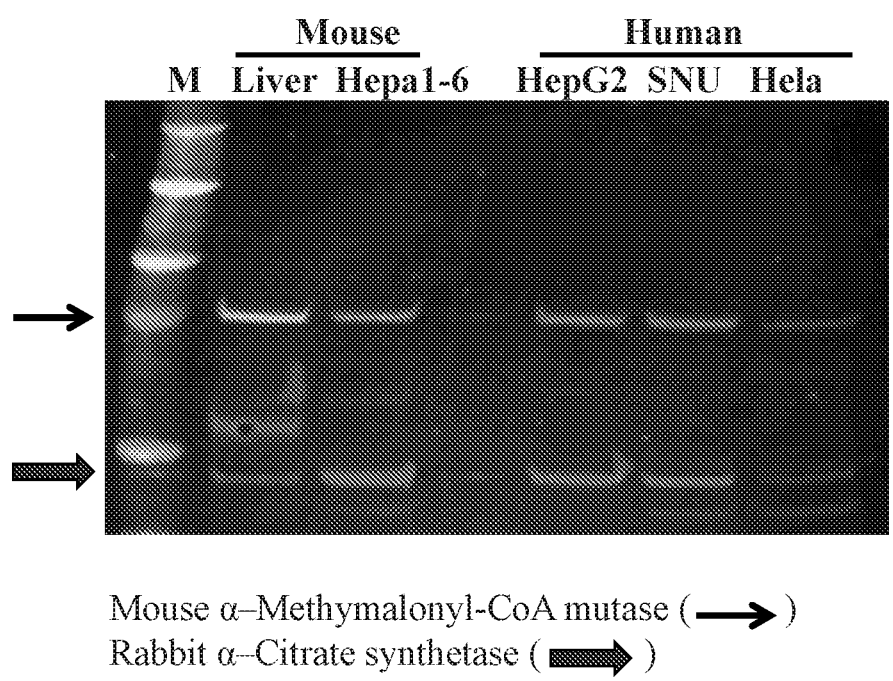
FIG. 1 is a Western blot analysis of endogenous methylmalonyl-CoA mutase expression in a mouse liver mitochondrial extract, mouse cells (Hepa1-6), and human cells (HepG2, SNU423, and HeLa). The upper band (thin arrow) shows Mouse α-Methymalonyl-CoA mutase, and the lower band (thick arrow) shows Rabbit α-Citrate synthetase.

The present disclosure provides polynucleotide sequences that encode a sequence-optimized nucleic acid encoding a methylmalonyl-CoA mutase polypeptide ("MCM" or "MUT"). MCM is the principal gene associated with methylmalonic acidemia ("MMA," also referred to as methylmalonic adicuria). Wild type nucleic acid and amino acid sequences for human methylmalonyl-CoA mutase (MCM) are described in NCBI sequence records gi296010795 (reference sequence NM_000255.3, "Homo sapiens methylmalonyl-CoA mutase (MUT), mRNA"; see also, SEQ ID NO: 214) and gi156105689 (reference sequence NP_000246.2, "methylmalonyl-CoA mutase, mitochondrial precursor [Homo sapiens]"; see also, SEQ ID NO: 208), respectively. Accession numbers and the associated sequences are found at the National Center for Biotechnology Information (NCBI) website.

MCM is a metabolic enzyme (E.C. 5.4.99.2), the biological function of which is to isomerize L-methylmalonyl-CoA into succinyl-CoA, a Krebs cycle intermediate. MCM localizes to the mitochondria of cells, exists as a homodimer in its native form, and is adenosylcobalamin-dependent. The precursor form of human MCM is 750 amino acids, while its mature form is 718 amino acids—a 32 amino acid leader sequence is cleaved off by mitochondrial importation and processing machinery.

I. Composition

Polynucleotides Encoding MCM

In certain aspects, the present disclosure provides nucleic acid molecules, specifically polynucleotides that encode one or more MCM polypeptides. The MCM polypeptides that are encoded can be mammalian MCM polypeptides, for example, human MCM peptides, or functional fragments thereof.

In some embodiments, the polynucleotides described herein encode at least one methylmalonyl-CoA mutase protein, functional fragment, or variant thereof. MCM catalyzes enzymatic transformation of methylmalonyl-CoA into succinyl-CoA, and also comprises a cobalamin-binding domain. MCM's enzymatic activity is dependent on its binding to its cofactor, denosylcobalamin.

MCM plays a critical role in the catabolism of fat and protein, specifically in disposing of methylmalonyl-CoA created during metabolism. For example, methylmalonyl-CoA is an intermediate in the catabolism of amino acids such as isoleucine, methionine, and threonine. Methylmalonyl-CoA is also an intermediate in the catabolism of cholesterol and fatty acids. Defects in the activity of this enzyme lead to inefficient metabolism and buildup of potentially toxic metabolic intermediates such as methylmalonic acid. The lack of MCM causes the disorder known as methylmalonic acidemia (MMA).

Replacement of MCM has been theorized to be a cure of this form of MMA. In some embodiments, the polynucleotides disclosed herein comprise one or more sequences encoding a methylmalonyl-CoA mutase protein, functional fragment, or variant thereof that is suitable for use in such gene replacement therapy. In certain aspects, the present application addresses the problem of the lack of methylmalonyl-CoA mutase by providing a polynucleotide, e.g., mRNA, that encodes methylmalonyl-CoA mutase or functional fragment thereof, wherein the polynucleotide is sequence-optimized. In some embodiments, the polynucleotide, e.g., mRNA, increases MCM expression levels in cells when introduced into those cells, e.g., by at least 20%, at least 20%, at least 25%, at least 35%, at least 40%, at least 50%, at least 60%, at least 70%, at least 80%, at least 90%, or at least 100%.

In some embodiments, the polynucleotides of the disclosure encode functional MCM polypeptides or fragments thereof. In some embodiments, the polynucleotides of the disclosure encode an MCM protein or variant thereof that is full length (i.e., it includes a mitochondrial transit peptide, either native or heterologous to that in native full-length MCM), while in other embodiments polynucleotides of the disclosure encode a functional MCM protein or variant thereof that is mature (i.e., it lacks the mitochondrial transit peptide). In some embodiments, the polynucleotides encode a human MCM, or variant thereof, linked to a heterologous or homologous mitochondrial transit peptide.

In some embodiments, the polynucleotides of the disclosure encode functional human MCM (SEQ ID NO: 208, SEQ ID NO: 209, SEQ ID NO: 210, SEQ ID NO: 211, SEQ ID NO: 212, and SEQ ID NO: 213) or fragments thereof. In some embodiments, the polynucleotides of the disclosure encode mutant MCM. In some embodiments, the polynucleotides encode an MCM polypeptide that comprises at least one point mutation in the MCM sequence, while still retaining MCM enzymatic activity. In some embodiments, the polynucleotides encode a functional MCM polypeptide with mutations that do not alter the function of MCM. Such functional MCM can be referred to as function-neutral. In some embodiments, the encoded MCM polypeptide comprises one or more of the function-neutral point mutations V69, T499, H532, A598, and V671. In some embodiments, the polynucleotides of the disclosure encode the polypeptide sequences in SEQ ID NO: 209, SEQ ID NO: 210, SEQ ID NO: 211, SEQ ID NO: 212, and SEQ ID NO: 213, which contain the function-neutral mutants V69, T499, H532, A598, and V671, respectively. In particular embodiments, the encoded MCM polypeptide is a V671 mutant (SEQ ID NO: 213). Polynucleotides encoding MCM polypeptides are listed in SEQ ID NOs: 1 to 207, 214, 732 to 765, and 772.

In some embodiments, the polynucleotides comprise a nucleotide sequence having significant sequence similarity to a polynucleotide selected from the group of SEQ ID NOs: 1-207, 732-765, and 772, wherein the ORF encodes an MCM polypeptide. In some embodiments, the polynucleotide comprises a nucleotide sequence having significant sequence similarity to SEQ ID NOs: 151, 152, 153, 154, 732, 733, and 734 (FIGS. 9-15). In some embodiments, the polynucleotide comprises a nucleotide sequence having significant sequence similarity to SEQ ID NO: 734 (FIG. 11).

In some embodiments, the disclosure is directed to a polynucleotide comprising an ORF having at least 99% or 100% sequence identity to nucleotide 97 to nucleotide 2250 of SEQ ID NO: 734, wherein the ORF encodes an MCM polypeptide.

In some embodiments, the disclosure is directed to a polynucleotide comprising an ORF having at least 98%, at least 99%, or 100% sequence identity to nucleotide 97 to nucleotide 2250 of SEQ ID NO: 732, wherein the ORF encodes an MCM polypeptide.

In some embodiments, the disclosure is directed to a polynucleotide comprising an ORF having at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 182, 733, and 741, wherein the ORF encodes an MCM polypeptide.

In some embodiments, the disclosure is directed to a polynucleotide comprising an ORF having at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 735, 736, 738, 743, 744, 748, 749, 750, 754, 755, 758, 762, and 765, wherein the ORF encodes an MCM polypeptide.

In some embodiments, the disclosure is directed to a polynucleotide comprising an ORF having at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 180, 187, 737, 739, 740, 742, 745, 746, 747, 751, 752, 753, 757, 759, 760, 761, 763, and 764, wherein the ORF encodes an MCM polypeptide.

In some embodiments, the disclosure is directed to a polynucleotide comprising an ORF having at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 181 and 756, wherein the ORF encodes an MCM polypeptide.

In some embodiments, the disclosure is directed to a polynucleotide comprising an ORF having at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 154, 165, 171, 173, and 175, wherein the ORF encodes an MCM polypeptide.

In some embodiments, the disclosure is directed to a polynucleotide comprising an ORF having at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NO: 151, 152, 153, 163, 164, 166, 167, 168, 169, 170, 172, 177, 178, 179, 195, and 204, wherein the ORF encodes an MCM polypeptide.

In some embodiments, the disclosure is directed to a polynucleotide comprising an ORF having at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 156, 157, 158, 159, 160, 161, 162, 174 and 176, wherein the ORF encodes an MCM polypeptide.

In some embodiments, the disclosure is directed to a polynucleotide comprising an ORF having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 155 and 203, wherein the ORF encodes an MCM polypeptide.

In some embodiments, the disclosure is directed to a polynucleotide comprising an ORF having at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 64, 66, 71, 91, and 128, wherein the ORF encodes an MCM polypeptide.

In some embodiments, the disclosure is directed to a polynucleotide comprising an ORF having at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 9, 11, 18, 19, 21, 22, 23, 24, 32, 33, 37, 39, 40, 44, 45, 47, 50, 51, 52, 55, 57, 61, 65, 70, 79, 84, 86, 88, 90, 92, 98, 100, 115, 117, 126, 129, 135, 136, 137, 144, 148, 150, 184, 190, 191, and 206, wherein the ORF encodes an MCM polypeptide.

In some embodiments, the disclosure is directed to a polynucleotide comprising an ORF having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 3, 5, 6, 8, 10, 12, 14, 16, 17, 20, 27, 28, 29, 31, 34, 35, 36, 38, 41, 42, 43, 46, 48, 49, 53, 54, 56, 58, 60, 63, 68, 69, 74, 77, 78, 80, 83, 85, 87, 93, 95, 96, 97, 99, 102, 103, 104, 105, 107, 110, 112, 113, 114, 116, 119, 120, 122, 123, 124, 125, 127, 131, 132, 133, 134, 138, 139, 140, 141, 142, 143, 147, 149, 183, 186, 188, 189, 192, 193, 194, 196, 197, 198, 199, 200, 201, 202, 205, and 207, wherein the ORF encodes an MCM polypeptide.

In some embodiments, the disclosure is directed to a polynucleotide comprising an ORF having at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 97 to nucleotides 2250 of SEQ ID NOs: 1, 2, 4, 7, 13, 15, 25, 26, 30, 59, 62, 67, 72, 73, 75, 76, 81, 82, 89, 94, 101, 106, 108, 109, 111, 118, 121, 130, 145, 146, and 185, wherein the ORF encodes an MCM polypeptide.

The polynucleotides of the disclosure can also encode additional features that facilitate trafficking of the polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. The disclosure also includes a polynucleotide comprising a sequence that encodes a mitochondrial transit peptide operably linked to the polynucleotide described herein, i.e., linked to a polynucleotide comprising an ORF encoding an MCM polypeptide.

As used herein, a "signal sequence" or "signal peptide" is a polynucleotide or polypeptide, respectively, which is from about 9 to 200 nucleotides (3-70 amino acids) in length that, in some embodiments, is incorporated at the 5' (or N-terminus) of the coding region or polypeptide encoded, respectively. Addition of these sequences result in trafficking of the encoded polypeptide to a desired site, such as the endoplasmic reticulum or the mitochondria through one or more targeting pathways. Some signal peptides are cleaved from the protein, for example by a signal peptidase after the proteins are transported.

For example, human MCM's precursor protein comprises a 32-amino acid mitochondrial transit peptide, also referred to as an MCM mitochondrial targeting sequence or mitochondrial targeting peptide, that facilitates delivery of the MCM protein to, and localization in, mitochondria. The present disclosure comprises both polynucleotides that encode a homologous targeting sequence (i.e., MCM's native mitochondrial transit sequence) and polynucleotides that encode a heterologous mitochondrial transit sequences (i.e., a mitochondrial transit peptide that is not the native targeting peptide for the operably linked MCM protein). In some embodiments, the alternate targeting sequences facilitate delivery of MCM to mitochondria.

Exemplary sequences of known mitochondrial transit peptides include MLSLRQSIRFFKPATRTLCSSRYLL (SEQ ID NO: 251), MALLRGVFVVAAKRTP (SEQ ID NO: 252) and MLRIPVRKALVGLSKSSKGCVRT (SEQ ID NO: 253). Non-limiting examples of the mitochondrial transit peptides are listed below in Table 1 (SEQ ID NOs: 251-265). Further examples of mitochondrial transit peptides are provided as SEQ ID NOs: 270-719. Additional mitochondrial transit peptides that can be utilized in the present disclosure can be identified using predictive tools known in the art. For example, mitochondrial targeting can be analyzed using the methods described in Fukusawa et al., Molecular and Cellular Proteomics 14:1113-1126 (2015), the contents of which are incorporated herein in their entirety.

TABLE 1

Mitochondrial Transit Peptides

| ID (SEQ ID NO) | Name of the protein | Sequence |
| --- | --- | --- |
| COX4 (SEQ ID NO: 251) | Saccharomyces cerevisiae mitochondrial cytochrome c oxidase subunit IV | MLSLRQSIRFFKPATRTLCSSRYLL |
| ACAA2 (SEQ ID NO: 252) | Mitochondrial 3-ketoacyl-coa thiolase | MALLRGVFVVAAKRTP |
| NDUFS1 (SEQ ID NO: 253) | NADH-ubiquinone oxidoreductase 75 kDa subunit, mitochondrial isoform 2 | MLRIPVRKALVGLSKSSKGCVRT |
| A6NK58 (SEQ ID NO: 254) | Putative lipoyltransferase 2, mitochondrial (EC 2.3.1.181) (Lipoate-protein ligase B) (Lipoyl/octanoyl transferase) (Octanoyl-[acyl-carrier-protein]-protein N-octanoyltransferase) | MRQPAVRLVRLGRVPYAELLGLQDRWLR RLQ |
| A8K5M9 (SEQ ID NO: 255) | Uncharacterized protein C15orf62, mitochondrial | METWRKGSFRN |
| A8MUP2 (SEQ ID NO: 256) | Methyltransferase-like protein 12, mitochondrial (EC 2.1.1.—) | MAALRRMLHLPSLMMGTCRPFAGSLADS |
| O00142 (SEQ ID NO: 257) | Thymidine kinase 2, mitochondrial (EC 2.7.1.21) (Mt-TK) | MLLWPLRGWAARALRCFGPGSRGSPASG PGPRR |
| O00217 (SEQ ID NO: 258) | NADH dehydrogenase [ubiquinone] iron-sulfur protein 8, mitochondrial (EC 1.6.5.3) (EC 1.6.99.3) (Complex I-23 kD) (CI-23 kD) (NADH-ubiquinone oxidoreductase 23 kDa subunit) (TYKY subunit) | MRCLTTPMLLRALAQAARAGPPGGRSLH SSAVAA |
| O00330 (SEQ ID NO: 259) | Pyruvate dehydrogenase protein X component, mitochondrial (Dihydrolipoamide dehydrogenase-binding protein of pyruvate dehydrogenase complex) (E3-binding protein) (E3BP) (Lipoyl-containing pyruvate dehydrogenase complex component X) (proX) | MAASWRLGCDPRLLRYLVGFPGRRSVGL VKGALGWSVSRGANWRWFHSTQWLR |
| O00411 (SEQ ID NO: 260) | DNA-directed RNA polymerase, mitochondrial (MtRPOL) (EC 2.7.7.6) | MSALCWGRGAAGLKRALRPCGRPGLPGK EGTAGGVCGPRRS |
| O00746 (SEQ ID NO: 261) | Nucleoside diphosphate kinase, mitochondrial (NDK) (NDP kinase, mitochondrial) (EC 2.7.4.6) (Nucleoside diphosphate kinase D) (NDPKD) (nm23-H4) | MGGLFWRSALRGLRCGPRAPGPSLLVRH GSGGP |
| O14521 (SEQ ID NO: 262) | Succinate dehydrogenase [ubiquinone] cytochrome b small subunit, mitochondrial (CybS) (CII-4) (QPs3) (Succinate dehydrogenase complex subunit D) (Succinate-ubiquinone oxidoreductase cytochrome b small subunit) (Succinate-ubiquinone reductase membrane anchor subunit) | MAVLWRLSAVCGALGGRALLLRTPVVRP AHISAFLQDRPIPEWCGVQHIHLSPSHH |
| O14548 (SEQ ID NO: 263) | Cytochrome c oxidase subunit 7A-related protein, mitochondrial (COX7a-related protein) (Cytochrome c oxidase subunit VIIa-related protein) (EB1) | MYYKFSGFTQKLAGAWASEAYSPQGLKP VVSTEAPPIIFATPTKLTSDSTVYDYA |
| mMCM (SEQ ID NO: 264) | Mouse methylmalonyl-CoA mutase | MLRAKNQLFLLSPHYLKQLNIPSASRWK RL |
| hMCM (SEQ ID NO: 265) | Human methylmalonyl-CoA mutase | MLRAKNQLFLLSPHYLRQVKESSGSRLI QQRL |

In some embodiments, the nucleic acid sequence encoding a mitochondrial transit peptide has at least about 70%, at least about 80%, at least about 90%, at least about 95%, at least about 96%, at least about 97%, at least about 98%, at least about 99%, or about 100% sequence identity to a sequence selected from the group of nucleotides 1 to 96 of SEQ ID NOs: 1-207, 732-765, and 772, wherein the transit peptide is capable of targeting or carrying the MCM polypeptide into the mitochondria.

In some embodiments, the nucleic acid sequence encoding a mitochondrial transit peptide has at least about 70%, at least about 80%, at least about 90%, at least about 95%, at least about 96%, at least about 97%, at least about 98%, at least about 99%, or about 100% sequence identity to a sequence in Table 1 (SEQ ID NOs: 251, 252, 253, 254, 255, 256, 257, 258, 259, 260, 261, 262, 263, 264, or 265), wherein the transit peptide is capable of targeting or carrying the MCM polypeptide into the mitochondria. In some embodiments, the nucleic acid sequence encoding a mitochondrial transit peptide has at least about 70%, at least about 80%, at least about 90%, at least about 95%, at least about 96%, at least about 97%, at least about 98%, at least about 99%, or about 100% sequence identity to a sequence selected from the group consisting of SEQ ID NOs: 270 to 719, wherein the transit peptide is capable of targeting or carrying the MCM polypeptide into the mitochondria.

In some embodiments, the disclosure is directed to a polynucleotide comprising an ORF having at least 99% or 100% sequence identity to nucleotide 1 to nucleotide 2250 of SEQ ID NO: 734, wherein the ORF encodes an MCM polypeptide.

In some embodiments, the disclosure is directed to a polynucleotide comprising an ORF having at least 98%, at least 99%, or 100% sequence identity to nucleotide 1 to nucleotide 2250 of SEQ ID NO: 732, wherein the ORF encodes an MCM polypeptide.

In some embodiments, the disclosure is directed to a polynucleotide comprising an ORF having at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 182 and 733, wherein the ORF encodes an MCM polypeptide.

In some embodiments, the disclosure is directed to a polynucleotide comprising an ORF having at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 735, 741, 743, 744, 748, 758, 762, and 765, wherein the ORF encodes an MCM polypeptide.

In some embodiments, the disclosure is directed to a polynucleotide comprising an ORF having at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 180, 181, 736, 738, 739, 740, 742, 746, 747, 749, 750, 751, 752, 753, 754, 755, 757, 759, 760, 761, and 763, wherein the ORF encodes an MCM polypeptide.

In some embodiments, the disclosure is directed to a polynucleotide comprising an ORF having at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 745, 756, and 764, wherein the ORF encodes an MCM polypeptide.

In some embodiments, the disclosure is directed to a polynucleotide comprising an ORF having at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 154, 165, 171, 173, and 175, wherein the ORF encodes an MCM polypeptide.

In some embodiments, the disclosure is directed to a polynucleotide comprising an ORF having at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 151, 152, 153, 163, 166, 167, 168, 169, 170, 172, 177, 178, 179, 187, and 204, wherein the ORF encodes an MCM polypeptide.

In some embodiments, the disclosure is directed to a polynucleotide comprising an ORF having at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NO: 156, 157, 158, 159, 160, 162, 164, 174, 176, 195, and 737, wherein the ORF encodes an MCM polypeptide.

In some embodiments, the disclosure is directed to a polynucleotide comprising an ORF having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 155, 161, and 203, wherein the ORF encodes an MCM polypeptide.

In some embodiments, the disclosure is directed to a polynucleotide comprising an ORF having at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 71 and 128, wherein the ORF encodes an MCM polypeptide.

In some embodiments, the disclosure is directed to a polynucleotide comprising an ORF having at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 4, 6, 8, 9, 11, 19, 22, 23, 24, 32, 33, 37, 40, 44, 45, 47, 51, 61, 64, 65, 66, 79, 84, 86, 90, 91, 92, 100, 101, 112, 115, 117, 126, 129, 135, 136, 146, 148, 184, 190, and 191, wherein the ORF encodes an MCM polypeptide.

In some embodiments, the disclosure is directed to a polynucleotide comprising an ORF having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 2, 3, 5, 7, 10, 12, 13, 14, 15, 16, 18, 20, 21, 26, 27, 28, 29, 31, 34, 36, 38, 39, 41, 42, 43, 46, 48, 49, 52, 53, 54, 55, 56, 57, 58, 59, 60, 62, 68, 69, 70, 72, 73, 74, 76, 77, 80, 83, 85, 88, 95, 96, 97, 98, 102, 104, 105, 106, 107, 108, 109, 110, 113, 114, 120, 121, 122, 123, 124, 127, 131, 132, 133, 134, 137, 138, 139, 140, 141, 142, 144, 145, 147, 149, 150, 186, 188, 189, 192, 193, 194, 196, 198, 199, 200, 202, 205, 206, and 207, wherein the ORF encodes an MCM polypeptide.

In some embodiments, the disclosure is directed to a polynucleotide comprising an ORF having at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of nucleotides 1 to nucleotides 2250 of SEQ ID NOs: 1, 17, 25, 30, 35, 50, 63, 67, 75, 78, 81, 82, 87, 89, 93, 94, 99, 103, 111, 116, 118, 119, 125, 130, 143, 183, 185, 197, and 201, wherein the ORF encodes an MCM polypeptide.

In some embodiments, the polynucleotide includes from about 1500 to about 100,000 nucleotides (e.g., from about 1500 to 2500, from about 1800 to about 2600, from about 1900 to about 2600, from about 2000 to about 2700, from 2154 to 2,750, from 2154 to 3,000, from 2154 to 5,000, from 2154 to 7,000, from 2154 to 10,000, from 2154 to 25,000, from 2154 to 50,000, from 2154 to 70,000, from 2154 to 100,000, from 2250 to 2750, from 2250 to 3,000, from 2250 to 5,000, from 2250 to 7,000, from 2250 to 10,000, from 2250 to 25,000, from 2250 to 50,000, from 2250 to 70,000, and from 2250 to 100,000 nucleotides).

In some embodiments, the polynucleotides of the present disclosure can further comprise at least one nucleic acid sequence that is non-coding.

In some embodiments, the length of a region encoding at least one polypeptide of interest is greater than about 2154 nucleotides in length (e.g., at least or greater than about 2154, 2,250, 2,500, 3,000, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region can be referred to as a "coding region" or "region encoding."

In some embodiments, the polynucleotides of the present disclosure are, or function as, a messenger RNA (mRNA). As used herein, the term "messenger RNA" (mRNA) refers to any polynucleotide that encodes at least one polypeptide of interest and that is capable of being translated to produce the encoded polypeptide of interest in vitro, in vivo, in situ or ex vivo. Exemplary mRNAs that can be used are listed in SEQ ID NOs: 776-771.

Optimized Polynucleotides Encoding MCM

The polynucleotides of the disclosure, their regions or parts or subregions are sequence-optimized. Sequence optimization methods are known in the art and can be useful to achieve one or more desired results. These results include to match codon frequencies in target and host organisms to ensure proper folding, bias GC content to increase mRNA stability or reduce secondary structures, minimize tandem repeat codons or base runs that can impair gene construction or expression, customize transcriptional and translational control regions, insert or remove protein trafficking sequences, remove/add post translation modification sites in encoded protein (e.g., glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the polynucleotide.

Sequence optimization tools, algorithms and services are known in the art, non-limiting examples include services from GeneArt (Life Technologies), DNA2.0 (Menlo Park Calif.) and/or proprietary methods. In some embodiments, the ORF sequence is optimized using optimization algorithms. Codon options for each amino acid are given in Table 2.

TABLE 2

Codon Options

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocysteine insertion element (SECIS) |
| Stop codons | Stop | TAA, TAG, TGA |

In some embodiments, the percentage of uracil or thymine nucleobases in a sequence-optimized nucleotide sequence (e.g., encoding an MCM polypeptide, a functional fragment, or a variant thereof) is modified (e.g., reduced) with respect to the percentage of uracil or thymine nucleobases in the reference wild-type nucleotide sequence. Such a sequence is referred to as a uracil-modified or thymine-modified sequence. The percentage of uracil or thymine content in a nucleotide sequence can be determined by dividing the number of uracils or thymines in a sequence by the total number of nucleotides and multiplying by 100. In some embodiments, the sequence-optimized nucleotide sequence has a lower uracil or thymine content than the uracil or thymine content in the reference wild-type sequence. In some embodiments, the uracil or thymine content in a sequence-optimized nucleotide sequence of the disclosure is greater than the uracil or thymine content in the reference wild-type sequence and still maintain beneficial effects, e.g., increased expression and/or reduced Toll-Like Receptor (TLR) response when compared to the reference wild-type sequence.

The uracil or thymine content of wild-type MCM is about 26.67%. In some embodiments, the uracil or thymine content of a uracil- or thymine-modified sequence encoding an MCM polypeptide is less than 26.67%. In some embodiments, the uracil or thymine content of a uracil- or thymine-modified sequence encoding an MCM polypeptide of the disclosure is less than 19%, less that 18%, less than 17%, less than 16%, less than 15%, less than 14%, less than 13%, less than 12%, less than 11%, or less than 10%. In some embodiments, the uracil or thymine content is not less than 18%, 17%, 16%, 15%, 14%, 13%, 12%, or 11%. The uracil or thymine content of a sequence disclosed herein, i.e., its total uracil or thymine content, is abbreviated herein as % $U_{TL}$ or % $T_{TL}$.

In some embodiments, the uracil or thymine content (% $U_{TL}$ or % $T_{TL}$) of a uracil- or thymine-modified sequence encoding an MCM polypeptide of the disclosure is between 11% and 26%, between 12% and 25%, between 12% and 24%, between 13% and 23%, between 13% and 22%, between 14% and 21%, between 14% and 20%, between 14% and 19%, between 14% and 18%, between 14% and 17%, or between 14% and 16%.

In some embodiments, the uracil or thymine content (% $U_{TL}$ or % $T_{TL}$) of a uracil- or thymine-modified sequence encoding an MCM polypeptide of the disclosure is between 13% and 17%, between 13% and 16%, or between 14% and 16%.

In a particular embodiment, the uracil or thymine content (% $U_{TL}$ or % $T_{TL}$) of a uracil- or thymine modified sequence encoding an MCM polypeptide of the disclosure is between about 14% and about 16%, e.g., between 14% and 15%.

A uracil- or thymine-modified sequence encoding an MCM polypeptide of the disclosure can also be described according to its uracil or thymine content relative to the uracil or thymine content in the corresponding wild-type nucleic acid sequence (% $U_{WT}$ or % $T_{WT}$), or according to its uracil or thymine content relative to the theoretical minimum uracil or thymine content of a nucleic acid encoding the wild-type protein sequence (% $U_{TM}$ or (% $T_{TM}$).

The phrases "uracil or thymine content relative to the uracil or thymine content in the wild type nucleic acid sequence," refers to a parameter determined by dividing the number of uracils or thymines in a sequence-optimized nucleic acid by the total number of uracils or thymines in the corresponding wild-type nucleic acid sequence and multiplying by 100. This parameter is abbreviated herein as % $U_{WT}$ or % $T_{WT}$.

In some embodiments, the % $U_{WT}$ or % $T_{WT}$ of a uracil- or thymine-modified sequence encoding an MCM polypeptide of the disclosure is above 50%, above 55%, above 60%, above 65%, above 70%, above 75%, above 80%, above 85%, above 90%, or above 95%.

In some embodiments, the % $U_{WT}$ or % $T_{WT}$ of a uracil- or thymine modified sequence encoding an MCM polypeptide of the disclosure is between 42% and 68%, between 43% and 67%, between 44% and 66%, between 45% and 65%, between 46% and 64%, between 47% and 63%, between 48% and 62%, between 49% and 61%, between 50% and 60%, between 51% and 59%, or between 52% and 58%.

In some embodiments, the % $U_{WT}$ or % $T_{WT}$ of a uracil- or thymine-modified sequence encoding an MCM polypeptide of the disclosure is between 51% and 60%, between 51% and 59%, between 52% and 59%, between 52% and 58%, or between 53% and 58%.

In a particular embodiment, the % $U_{WT}$ or % $T_{WT}$ of a uracil- or thymine-modified sequence encoding an MCM polypeptide of the disclosure is between about 53% and about 58%.

Uracil- or thymine-content relative to the uracil or thymine theoretical minimum, refers to a parameter determined by dividing the number of uracils or thymines in a sequence-optimized nucleotide sequence by the total number of uracils or thymines in a hypothetical nucleotide sequence in which all the codons in the hypothetical sequence are replaced with synonymous codons having the lowest possible uracil or thymine content and multiplying by 100. This parameter is abbreviated herein as % $U_{TM}$ or % $T_{TM}$.

For DNA it is recognized that thymine is present instead of uracil, and one would substitute T where U appears. Thus, all the disclosures related to, e.g., % $U_{TM}$, % $U_{WT}$, or % $U_{TL}$, with respect to RNA are equally applicable to % $U_{TM}$% $T_{WT}$, or % $T_{TL}$ with respect to DNA.

In some embodiments, the % $U_{TM}$ of a uracil-modified sequence encoding an MCM polypeptide of the disclosure is below 300%, below 295%, below 290%, below 285%, below 280%, below 275%, below 270%, below 265%, below 260%, below 255%, below 250%, below 245%, below 240%, below 235%, below 230%, below 225%, below 220%, below 215%, below 200%, below 195%, below 190%, below 185%, below 180%, below 175%, below 170%, below 165%, below 160%, below 155%, below 150%, below 145%, below 140%, below 139%, below 138%, below 137%, below 136%, below 135%, below 134%, below 133%, below 132%, below 131%, below 130%, below 129%, below 128%, below 127%, below 126%, below 125%, below 124%, below 123%, below 122%, below 121%, below 120%, below 119%, below 118%, or below 117%.

In some embodiments, the % $U_{TM}$ of a uracil-modified sequence encoding an MCM polypeptide of the disclosure is above 100%, above 101%, above 102%, above 103%, above 104%, above 105%, above 106%, above 107%, above 108%, above 109%, above 110%, above 111%, above 112%, above 113%, above 114%, above 115%, above 116%, above 117%, above 118%, above 119%, above 120%, above 121%, above 122%, above 123%, above 124%, above 125%, or above 126%, above 127%, above 128%, or above 129%.

In some embodiments, the % $U_{TM}$ of a uracil-modified sequence encoding an MCM polypeptide of the disclosure is between 123% and 125%, between 122% and 126%, between 121% and 127%, between 120% and 128%, between 119% and 129%, between 118% and 130%, between 117% and 131%, between 116% and 132%, between 115% and 133%, between 114% and 134%, between 113% and 135%, between 112% and 136%, or between 111% and 137%.

In some embodiments, the % $U_{TM}$ of a uracil-modified sequence encoding an MCM polypeptide of the disclosure is between about 118% and about 129%.

In some embodiments, a uracil-modified sequence encoding an MCM polypeptide of the disclosure has a reduced number of consecutive uracils with respect to the corresponding wild-type nucleic acid sequence. For example, two consecutive leucines can be encoded by the sequence CUUUUG, which includes a four uracil cluster. Such a subsequence can be substituted, e.g., with CUGCUC, which removes the uracil cluster.

Phenylalanine can be encoded by UUC or UUU. Thus, even if phenylalanines encoded by UUU are replaced by UUC, the synonymous codon still contains a uracil pair (UU). Accordingly, the number of phenylalanines in a sequence establishes a minimum number of uracil pairs (UU) that cannot be eliminated without altering the number of phenylalanines in the encoded polypeptide. For example, if the polypeptide, e.g., wild type MCM, has 27, 28, 29, or 30 phenylalanines, the absolute minimum number of uracil pairs (UU) in that uracil-modified sequence encoding the polypeptide, e.g., wild type MCM, can contain is 27, 28, 29, or 30, respectively.

Wild type MCM contains 82 uracil pairs (UU), and 29 uracil triplets (UUU). In some embodiments, a uracil-modified sequence encoding an MCM polypeptide of the disclosure has a reduced number of uracil triplets (UUU) with respect to the wild-type nucleic acid sequence. In some embodiments, a uracil-modified sequence encoding an MCM polypeptide of the disclosure contains 28, 27, 26, 25, 24, 23, 22, 21, 20, 19, 18, 17, 16, 15, 14, 13, 12, 11, 10, 9, 8, 7, 6, 5, 4, 3, 2, 1 or no uracil triplets (UUU).

In some embodiments, a uracil-modified sequence encoding an MCM polypeptide has a reduced number of uracil pairs (UU) with respect to the number of uracil pairs (UU) in the wild-type nucleic acid sequence. In some embodiments, a uracil-modified sequence encoding an MCM polypeptide of the disclosure has a number of uracil pairs (UU) corresponding to the minimum possible number of uracil pairs (UU) in the wild-type nucleic acid sequence, e.g., 28 uracil pairs in the case of wild type MCM.

In some embodiments, a uracil-modified sequence encoding an MCM polypeptide of the disclosure has at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, or 54 uracil pairs (UU) less than the number of uracil pairs (UU) in the wild-type nucleic acid sequence. In some embodiments, a uracil-modified sequence encoding an MCM polypeptide of the disclosure has between 20 and 35 uracil pairs (UU).

The phrase "uracil pairs (UU) relative to the uracil pairs (UU) in the wild type nucleic acid sequence," refers to a parameter determined by dividing the number of uracil pairs (UU) in a sequence-optimized nucleotide sequence by the total number of uracil pairs (UU) in the corresponding wild-type nucleotide sequence and multiplying by 100. This parameter is abbreviated herein as % $UU_{wt}$.

In some embodiments, a uracil-modified sequence encoding an MCM polypeptide of the disclosure has a % $UU_{wt}$ less than 90%, less than 85%, less than 80%, less than 75%, less than 70%, less than 65%, less than 60%, less than 65%, less than 60%, less than 55%, less than 50%, less than 40%, less than 30%, or less than 20%.

In some embodiments, a uracil-modified sequence encoding an MCM polypeptide has a % $UU_{wt}$ between 20% and 50%. In a particular embodiment, a uracil-modified sequence encoding an MCM polypeptide of the disclosure has a % $UU_{wt}$ between 24% and 43%.

In some embodiments, the polynucleotide of the disclosure comprises a uracil-modified sequence encoding an MCM polypeptide disclosed herein. In some embodiments, the uracil-modified sequence encoding an MCM polypeptide comprises at least one chemically modified nucleobase, e.g., 5-methoxyuracil. In some embodiments, at least 95% of a nucleobase (e.g., uracil) in a uracil-modified sequence encoding an MCM polypeptide of the disclosure are modified nucleobases. In some embodiments, at least 95% of uracil in a uracil-modified sequence encoding an MCM polypeptide is 5-methoxyuracil.

In some embodiments, the "guanine content of the sequence optimized ORF encoding MCM with respect to the theoretical maximum guanine content of a nucleotide sequence encoding the MCM polypeptide," abbreviated as % $G_{TMX}$ is at least 69%, at least 70%, at least 75%, at least about 80%, at least about 85%, at least about 90%, at least about 95%, or about 100%. In some embodiments, the % $G_{TMX}$ is between about 70% and about 80%, between about 71% and about 79%, between about 71% and about 78%, between about 71% and about 77% or between about 71% and about 76%.

In some embodiments, the "cytosine content of the ORF relative to the theoretical maximum cytosine content of a nucleotide sequence encoding the MCM polypeptide," abbreviated as % $C_{TMX}$, is at least about 68%, at least about 70%, at least about 75%, at least about 80%, at least about 85%, at least about 90%, at least about 95%, or about 100%. In some embodiments, the % $C_{TMX}$ is between about 68% and about 77%, between about 69% and about 76%, or between about 70% and about 75%.

In some embodiments, the "guanine and cytosine content (G/C) of the ORF relative to the theoretical maximum G/C content in a nucleotide sequence encoding the MCM polypeptide," abbreviated as % $G/C_{TMX}$ is at least about 85%, at least about 90%, at least about 95%, or about 100%. The % $G/C_{TMX}$ is between about 85% and about 100%, between about 89% and about 96%, between about 90% and about 95%, or between about 91% and about 94%.

In some embodiments, the "G/C content in the ORF relative to the G/C content in the corresponding wild-type ORF," abbreviated as % $G/C_{WT}$ is at least 120%, at least 130%, at least 140%, at least 141%, at least 142%, at least 143%, at least 144%, at least 145%, at least 146%, at least 147%, at least 150%, or at least 155%.

In some embodiments, the average G/C content in the 3rd codon position in the ORF is at least 50%, at least 51%, at least 52%, at least 53%, at least 54%, at least 55%, at least 56%, at least 57%, at least 58%, at least 59%, or at least 60% higher than the average G/C content in the 3rd codon position in the corresponding wild-type ORF.

In some embodiments, the polynucleotide of the disclosure comprises an open reading frame (ORF) encoding an MCM polypeptide, wherein the ORF has been sequence optimized, and wherein each of % $U_{TL}$, % $U_{WT}$, % $U_{TM}$, % $G_{TL}$, % $G_{WT}$, % $G_{TMX}$, % $C_{TL}$, % $C_{WT}$, % $C_{TMX}$, % $G/C_{TL}$, % $G/C_{WT}$, or % $G/C_{TMX}$, alone or in a combination thereof is in a range between (i) a maximum corresponding to the parameter's maximum value (MAX) plus about 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV), and (ii) a minimum corresponding to the parameter's minimum value (MIN) less 0.5, 1, 1.5, 2, 2.5, 3, 3.5, 4, 4.5, 5, 5.5, 6, 6.5, 7, 7.5, 8, 8.5, 9, 9.5, or 10 standard deviations (STD DEV).

Features, which can be considered beneficial in some embodiments of the present disclosure, can be encoded by regions of the polynucleotide and such regions can be upstream (5') or downstream (3') to, or within, a region that encodes a polypeptide. These regions can be incorporated into the polynucleotide before and/or after sequence optimization of the protein encoding region or open reading frame (ORF). It is not required that a polynucleotide contain both a 5' and 3' flanking region. Examples of such features include, but are not limited to, untranslated regions (UTRs), Kozak sequences, an oligo(dT) sequence, and detectable tags and can include multiple cloning sites that can have XbaI recognition.

In some embodiments, a 5' UTR and/or a 3' UTR region can be provided as flanking regions. Multiple 5' or 3' UTRs can be included in the flanking regions and can be the same or of different sequences. Any portion of the flanking regions, including none, can be sequence-optimized and any can independently contain one or more different structural or chemical modifications, before and/or after sequence optimization.

In some embodiments, the polynucleotide of the disclosure comprises, consists essentially or, or consists of the sequence set forth as SEQ ID NO: 769, wherein thymidine is changed to uridine. In other embodiments, the polynucleotide of the disclosure comprises, consists essentially or, or consists of the sequence set forth as SEQ ID NO: 770, wherein thymidine is changed to uridine. In other embodiments, the polynucleotide does not comprise a polyC.

After optimization (if desired), the polynucleotides components are reconstituted and transformed into a vector such as, but not limited to, plasmids, viruses, cosmids, and artificial chromosomes. For example, the optimized polynucleotide can be reconstituted and transformed into chemically competent *E. coli*, yeast, *neurospora*, maize, *drosophila*, etc. where high copy plasmid-like or chromosome structures occur by methods described herein.

Synthetic polynucleotides and their nucleic acid analogs play an important role in the research and studies of biochemical processes. Various enzyme-assisted and chemical-based methods have been developed to synthesize polynucleotides and nucleic acids.

Enzymatic methods include in vitro transcription that uses RNA polymerases to synthesize the polynucleotides of the present disclosure. Enzymatic methods and RNA polymerases for transcription are described in International Patent Application No. PCT/US2014/53907, the contents of which are herein incorporated by reference in its entirety.

Solid-phase chemical synthesis can be used to manufacture the polynucleotides described herein or portions thereof. Solid-phase chemical synthesis manufacturing of the polynucleotides described herein are described in International Patent Application No. PCT/US2014/53907, the contents of which are herein incorporated by reference in its entirety.

Liquid phase chemical synthesis can be used to manufacture the polynucleotides described herein or portions thereof. Liquid phase chemical synthesis manufacturing of the polynucleotides described herein are described in International Patent Application No. PCT/US2014/53907, the contents of which are herein incorporated by reference in its entirety.

Combinations of different synthetic methods can be used to manufacture the polynucleotides described herein or portions thereof. These combinations are described in International Patent Application No. PCT/US2014/53907, the contents of which are herein incorporated by reference in its entirety.

Small region synthesis can be used for regions or subregions of the polynucleotides of the present disclosure. These synthesis methods are described in International Patent Application No. PCT/US2014/53907, the contents of which are herein incorporated by reference in its entirety.

Ligation of polynucleotide regions or subregions can be used to prepare the polynucleotides described herein. These ligation methods are described in International Patent Application No. PCT/US2014/53907, the contents of which are herein incorporated by reference in its entirety.

Polypeptides Encoded by the Polynucleotides of the Disclosure

In some embodiments, the MCM polypeptides encoded by polynucleotides of the disclosure peptide are functional MCM. As used herein, the term "MCM" protein is used interchangeably with "MUT" protein. Therefore, human MCM protein can be written as human MUT or hMUT, and murine MCM protein can be written as murine MUT or mMUT. In some embodiments, the MCM polypeptides encoded by polynucleotides of the disclosure peptide are variants, peptides or polypeptides containing substitutions, insertions and/or additions, deletions and covalent modifications with respect to an MCM peptide sequence. For example, sequence tags or amino acids, such as one or more lysines, can be added to the peptide sequences encoded by the polynucleotides of the disclosure (e.g., at the N-terminal or C-terminal ends). Sequence tags can be used for peptide purification or localization. Lysines can be used to increase peptide solubility or to allow for biotinylation. In some embodiments, amino acid residues located at the carboxy and amino terminal regions of a polypeptide encoded by the polynucleotides of the disclosure can optionally be deleted providing for truncated sequences.

In some embodiments, the polynucleotides described herein encode a substitutional variant of an MCM protein. The substitutional variant can comprise one, two, three or more than three substitutions. "Substitutional variants" when referring to polypeptides are those that have at least one amino acid residue in a native or starting sequence removed and a different amino acid inserted in its place at the same position. The substitutions can be single, where only one amino acid in the molecule has been substituted, or they can be multiple, where two or more amino acids have been substituted in the same molecule.

In some embodiments, the polynucleotides described herein encode a variant of an MCM protein with one or more conservative amino acids substitutions. As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

In other embodiments, the polynucleotides encode an insertional MCM variant. "Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

In other embodiments, the polynucleotides of the disclosure encode a deletional MCM variant. "Deletional variants" when referring to polypeptides are those with one or more amino acids in the native or starting amino acid sequence removed. Ordinarily, deletional variants will have one or more amino acids deleted in a particular region of the molecule.

In some embodiments, the polynucleotides of the disclosure encode a covalent derivative. "Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues can be present in the polypeptides produced in accordance with the present disclosure.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features," when referring to polypeptides, are defined as distinct amino acid sequence-based components of a molecule. Features of the polypeptides encoded by the polynucleotides of the present disclosure include surface manifestations, local conformational shape, folds, loops, half-loops, domains, half-domains, sites, termini or any combination thereof.

As used herein, when referring to polypeptides, the term "domain" refers to a motif of a polypeptide having one or more identifiable structural or functional characteristics or properties (e.g., binding capacity, serving as a site for protein-protein interactions).

As used herein, when referring to polypeptides, the terms "site" as it pertains to amino acid based embodiments is used synonymously with "amino acid residue" and "amino acid side chain." A site represents a position within a peptide or polypeptide that can be modified, manipulated, altered, derivatized or varied within the polypeptide based molecules of the present disclosure.

As used herein the terms "termini" or "terminus," when referring to polypeptides, refers to an extremity of a peptide or polypeptide. Such extremity is not limited only to the first or final site of the peptide or polypeptide but can include additional amino acids in the terminal regions. The polypeptide based molecules of the present disclosure can be characterized as having both an N-terminus (terminated by an amino acid with a free amino group ($NH_2$)) and a C-terminus (terminated by an amino acid with a free carboxyl group (COOH)). Proteins of the disclosure are in some cases made up of multiple polypeptide chains brought together by disulfide bonds or by non-covalent forces (multimers, oligomers). These sorts of proteins will have multiple N- and C-termini. Alternatively, the termini of the polypeptides can be modified such that they begin or end, as the case can be, with a non-polypeptide based moiety such as an organic conjugate.

Once any of the features have been identified or defined as a desired component of a polypeptide to be encoded by the polynucleotide of the disclosure, any of several manipulations and/or modifications of these features can be performed by moving, swapping, inverting, deleting, randomizing or duplicating. Furthermore, it is understood that manipulation of features can result in the same outcome as a modification to the molecules of the disclosure. For example, a manipulation that involved deleting a domain would result in the alteration of the length of a molecule just as modification of a nucleic acid to encode less than a full length molecule would.

Modifications and manipulations can be accomplished by methods known in the art such as, but not limited to, site directed mutagenesis or a priori incorporation during chemical synthesis. The resulting modified molecules can then be tested for activity using in vitro or in vivo assays such as those described herein or any other suitable screening assay known in the art.

According to the present disclosure, the polypeptides can comprise a consensus sequence that is discovered through rounds of experimentation. As used herein a "consensus" sequence is a single sequence that represents a collective population of sequences allowing for variability at one or more sites.

As recognized by those skilled in the art, protein fragments, functional protein domains, and homologous proteins are also considered to be within the scope of polypeptides of interest of this disclosure. For example, provided herein is any protein fragment (meaning a polypeptide sequence at least one amino acid residue shorter than a reference polypeptide sequence but otherwise identical) of a reference protein 10, 20, 30, 40, 50, 60, 70, 80, 90, 100 or greater than 100 amino acids in length. In another example, any protein that includes a stretch of about 20, about 30, about 40, about 50, or about 100 amino acids that are about 40%, about 50%, about 60%, about 70%, about 80%, about 90%, about 95%, or about 100% identical to any of the sequences described herein can be utilized in accordance with the disclosure.

In certain embodiments, a polypeptide encoded by the polynucleotide of the disclosure includes 2, 3, 4, 5, 6, 7, 8, 9, 10, or more mutations as shown in any of the sequences provided or referenced herein.

In some embodiments, the encoded polypeptide variant has the same or a similar activity as the reference polypeptide. Alternatively, the variant has an altered activity (e.g., increased or decreased) relative to a reference polypeptide. Generally, variants of a particular polynucleotide or polypeptide of the disclosure will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schaffer, Jinghui Zhang, Zheng Zhang, Webb Miller, and David J. Lipman (1997), "Gapped BLAST and PSI-BLAST: a new generation of protein database search programs," Nucleic Acids Res. 25:3389-3402.) Other tools are described herein, specifically in the definition of "Identity."

Default parameters in the BLAST algorithm include, for example, an expect threshold of 10, Word size of 28, Match/Mismatch Scores 1, -2, Gap costs Linear. Any filter can be applied as well as a selection for species specific repeats, e.g., *Homo sapiens*.

According to the present disclosure, the protein is encoded by a polynucleotide that can comprise at least a first region of linked nucleosides encoding at least one polypeptide of interest. Some polypeptides encoded by the polynucleotides of interest of the present disclosure are listed in Table 3 below. In particular, Table 3 shows human MCM wild type and mutant amino acid sequences.

TABLE 3

MCM Polypeptides and Polynucleotides

| SEQ ID No | Gene | Sequence |
|---|---|---|
| SEQ ID NO: 208 | Functional Human MCM | MLRAKNQLFLLSPHYLRQVKESSGSRLIQQRLLHQQQPLHPEWAALAKKQLKGKNPED LIWHTPEGISIKPLYSKRDTMDLPEELPGVKPFTRGPYPTMYTFRPWTIRQYAGFSTV EESNKFYKDNIKAGQQGLSVAFDLATHRGYDSDNPRVRGDVGMAGVAIDTVEDTKILF DGIPLEKMSVSMTMNGAVIPVLANFIVTGEEQGVPKEKLTGTIQNDILKEFMVRNTYI FPPEPSMKIIADIFEYTAKHMPKFNSISISGYHMQEAGADAILELAYTLADGLEYSRT GLQAGLTIDEFAPRLSFFWGIGMNFYMEIAKMRAGRRLWAHLIEKMFQPKNSKSLLLR AHCQTSGWSLTEQDPYNNIVRTAIEAMAAVFGGTQSLHTNSFDEALGLPTVKSARIAR NTQIIIQEESGIPKVADPWGGSYMMECLTNDVYDAALKLINEIEEMGGMAKAVAEGIP KLRIEECAARRQARIDSGSEVIVGVNKYQLEKEDAVEVLAIDNTSVRNRQIEKLKKIK SSRDQALAERCLAALTECAASGDGNILALAVDASRARCTVGEITDALKKVFGEHKAND RMVSGAYRQEFGESKEITSAIKRVHKFMEREGRRPRLLVAKMGQDGHDRGAKVIATGF ADLGFDVDIGPLFQTPREVAQQAVDADVHAVGISTLAAGHKTLVPELIKELNSLGRPD ILVMCGGVIPPQDYEFLFEVGVSNVFGPGTRIPKAAVQVLDDIEKCLEKKQQSV |
| a.a. 33 to 750 of SEQ ID NO: 208 | Mature human MCM | LHQQQPLHPEWAALAKKQLKGKNPEDLIWHTPEGISIKPLYSKRDTMDLPEELPGVKP FTRGPYPTMYTFRPWTIRQYAGFSTVEESNKFYKDNIKAGQQGLSVAFDLATHRGYDS DNPRVRGDVGMAGVAIDTVEDTKILFDGIPLEKMSVSMTMNGAVIPVLANFIVTGEEQ GVPKEKLTGTIQNDILKEFMVRNTYIFPPEPSMKIIADIFEYTAKHMPKFNSISISGY HMQEAGADAILELAYTLADGLEYSRTGLQAGLTIDEFAPRLSFFWGIGMNFYMEIAKM RAGRRLWAHLIEKMFQPKNSKSLLLRAHCQTSGWSLTEQDPYNNIVRTAIEAMAAVFG GTQSLHTNSFDEALGLPTVKSARIARNTQIIIQEESGIPKVADPWGGSYMMECLTNDV YDAALKLINEIEEMGGMAKAVAEGIPKLRIEECAARRQARIDSGSEVIVGVNKYQLEK EDAVEVLAIDNTSVRNRQIEKLKKIKSSRDQALAERCLAALTECAASGDGNILALAVD ASRARCTVGEITDALKKVFGEHKANDRMVSGAYRQEFGESKEITSAIKRVHKFMEREG RRPRLLVAKMGQDGHDRGAKVIATGFADLGFDVDIGPLFQTPREVAQQAVDADVHAVG VSTLAAGHKTLVPELIKELNSLGRPDILVMCGGVIPPQDYEFLFEVGVSNVFGPGTRI PKAAVQVLDDIEKCLEKKQQSV |
| SEQ ID NO: 209 | Functional Human MCM I69V | MLRAKNQLFLLSPHYLRQVKESSGSRLIQQRLLHQQQPLHPEWAALAKKQLKGKNPED LIWHTPEGISVKPLYSKRDTMDLPEELPGVKPFTRGPYPTMYTFRPWTIRQYAGFSTV EESNKFYKDNIKAGQQGLSVAFDLATHRGYDSDNPRVRGDVGMAGVAIDTVEDTKILF DGIPLEKMSVSMTMNGAVIPVLANFIVTGEEQGVPKEKLTGTIQNDILKEFMVRNTYI FPPEPSMKIIADIFEYTAKHMPKFNSISISGYHMQEAGADAILELAYTLADGLEYSRT GLQAGLTIDEFAPRLSFFWGIGMNFYMEIAKMRAGRRLWAHLIEKMFQPKNSKSLLLR AHCQTSGWSLTEQDPYNNIVRTAIEAMAAVFGGTQSLHTNSFDEALGLPTVKSARIAR NTQIIIQEESGIPKVADPWGGSYMMECLTNDVYDAALKLINEIEEMGGMAKAVAEGIP KLRIEECAARRQARIDSGSEVIVGVNKYQLEKEDAVEVLAIDNTSVRNRQIEKLKKIK SSRDQALAERCLAALTECAASGDGNILALAVDASRARCTVGEITDALKKVFGEHKAND RMVSGAYRQEFGESKEITSAIKRVHKFMEREGRRPRLLVAKMGQDGHDRGAKVIATGF ADLGFDVDIGPLFQTPREVAQQAVDADVHAVGISTLAAGHKTLVPELIKELNSLGRPD ILVMCGGVIPPQDYEFLFEVGVSNVFGPGTRIPKAAVQVLDDIEKCLEKKQQSV |
| SEQ ID NO: 210 | Functional Human MCM A499T | MLRAKNQLFLLSPHYLRQVKESSGSRLIQQRLLHQQQPLHPEWAALAKKQLKGKNPED LIWHTPEGISIKPLYSKRDTMDLPEELPGVKPFTRGPYPTMYTFRPWTIRQYAGFSTV EESNKFYKDNIKAGQQGLSVAFDLATHRGYDSDNPRVRGDVGMAGVAIDTVEDTKILF DGIPLEKMSVSMTMNGAVIPVLANFIVTGEEQGVPKEKLTGTIQNDILKEFMVRNTYI FPPEPSMKIIADIFEYTAKHMPKFNSISISGYHMQEAGADAILELAYTLADGLEYSRT GLQAGLTIDEFAPRLSFFWGIGMNFYMEIAKMRAGRRLWAHLIEKMFQPKNSKSLLLR AHCQTSGWSLTEQDPYNNIVRTAIEAMAAVFGGTQSLHTNSFDEALGLPTVKSARIAR NTQIIIQEESGIPKVADPWGGSYMMECLTNDVYDAALKLINEIEEMGGMAKAVAEGIP KLRIEECAARRQARIDSGSEVIVGVNKYQLEKEDTVEVLAIDNTSVRNRQIEKLKKIK SSRDQALAERCLAALTECAASGDGNILALAVDASRARCTVGEITDALKKVFGEHKAND RMVSGAYRQEFGESKEITSAIKRVHKFMEREGRRPRLLVAKMGQDGHDRGAKVIATGF ADLGFDVDIGPLFQTPREVAQQAVDADVHAVGISTLAAGHKTLVPELIKELNSLGRPD ILVMCGGVIPPQDYEFLFEVGVSNVFGPGTRIPKAAVQVLDDIEKCLEKKQQSV |
| SEQ ID NO: 211 | Functional Human MCM R532H | MLRAKNQLFLLSPHYLRQVKESSGSRLIQQRLLHQQQPLHPEWAALAKKQLKGKNPED LIWHTPEGISIKPLYSKRDTMDLPEELPGVKPFTRGPYPTMYTFRPWTIRQYAGFSTV EESNKFYKDNIKAGQQGLSVAFDLATHRGYDSDNPRVRGDVGMAGVAIDTVEDTKILF DGIPLEKMSVSMTMNGAVIPVLANFIVTGEEQGVPKEKLTGTIQNDILKEFMVRNTYI FPPEPSMKIIADIFEYTAKHMPKFNSISISGYHMQEAGADAILELAYTLADGLEYSRT GLQAGLTIDEFAPRLSFFWGIGMNFYMEIAKMRAGRRLWAHLIEKMFQPKNSKSLLLR AHCQTSGWSLTEQDPYNNIVRTAIEAMAAVFGGTQSLHTNSFDEALGLPTVKSARIAR |

TABLE 3-continued

MCM Polypeptides and Polynucleotides

| SEQ ID No | Gene | Sequence |
|---|---|---|
| | | NTQIIIQEESGIPKVADPWGGSYMMECLTNDVYDAALKLINEIEEMGGMAKAVAEGIP
KLRIEECAARRQARIDSGSEVIVGVNKYQLEKEDAVEVLAIDNTSVRNRQIEKLKKIK
SSRDQALAEHCLAALTECAASGDGNILALAVDASRARCTVGEITDALKKVFGEHKAND
RMVSGAYRQEFGESKEITSAIKRVHKFMEREGRRPRLLVAKMGQDGHDRGAKVIATGF
ADLGFDVDIGPLFQTPREVAQQAVDADVHAVGISTLAAGHKTLVPELIKELNSLGRPD
ILVMCGGVIPPQDYEFLFEVGVSNVFGPGTRIPKAAVQVLDDIEKCLEKKQQSV |
| SEQ ID NO: 212 | Functional Human MCM T598A | MLRAKNQLFLLSPHYLRQVKESSGSRLIQQRLLHQQQPLHPEWAALAKKQLKGKNPED
LIWHTPEGISIKPLYSKRDTMDLPEELPGVKPFTRGPYPTMYTFRPWTIRQYAGFSTV
EESNKFYKDNIKAGQQGLSVAFDLATHRGYDSDNPRVRGDVGMAGVAIDTVEDTKILF
DGIPLEKMSVSMTMNGAVIPVLANFIVTGEEQGVPKEKLTGTIQNDILKEFMVRNTYI
FPPEPSMKIIADIFEYTAKHMPKFNSISISGYHMQEAGADAILELAYTLADGLEYSRT
GLQAGLTIDEFAPRLSFFWGIGMNFYMEIAKMRAGRRLWAHLIEKMFQPKNSKSLLLR
AHCQTSGWSLTEQDPYNNIVRTAIEAMAAVFGGTQSLHTNSFDEALGLPTVKSARIAR
NTQIIIQEESGIPKVADPWGGSYMMECLTNDVYDAALKLINEIEEMGGMAKAVAEGIP
KLRIEECAARRQARIDSGSEVIVGVNKYQLEKEDAVEVLAIDNTSVRNRQIEKLKKIK
SSRDQALAERCLAALTECAASGDGNILALAVDASRARCTVGEITDALKKVFGEHKAND
RMVSGAYRQEFGESKEIASAIKRVHKFMEREGRRPRLLVAKMGQDGHDRGAKVIATGF
ADLGFDVDIGPLFQTPREVAQQAVDADVHAVGISTLAAGHKTLVPELIKELNSLGRPD
ILVMCGGVIPPQDYEFLFEVGVSNVFGPGTRIPKAAVQVLDDIEKCLEKKQQSV |
| SEQ ID NO: 213 | Functional Human MCM I671V | MLRAKNQLFLLSPHYLRQVKESSGSRLIQQRLLHQQQPLHPEWAALAKKQLKGKNPED
LIWHTPEGISIKPLYSKRDTMDLPEELPGVKPFTRGPYPTMYTFRPWTIRQYAGFSTV
EESNKFYKDNIKAGQQGLSVAFDLATHRGYDSDNPRVRGDVGMAGVAIDTVEDTKILF
DGIPLEKMSVSMTMNGAVIPVLANFIVTGEEQGVPKEKLTGTIQNDILKEFMVRNTYI
FPPEPSMKIIADIFEYTAKHMPKFNSISISGYHMQEAGADAILELAYTLADGLEYSRT
GLQAGLTIDEFAPRLSFFWGIGMNFYMEIAKMRAGRRLWAHLIEKMFQPKNSKSLLLR
AHCQTSGWSLTEQDPYNNIVRTAIEAMAAVFGGTQSLHTNSFDEALGLPTVKSARIAR
NTQIIIQEESGIPKVADPWGGSYMMECLTNDVYDAALKLINEIEEMGGMAKAVAEGIP
KLRIEECAARRQARIDSGSEVIVGVNKYQLEKEDAVEVLAIDNTSVRNRQIEKLKKIK
SSRDQALAERCLAALTECAASGDGNILALAVDASRARCTVGEITDALKKVFGEHKAND
RMVSGAYRQEFGESKEITSAIKRVHKFMEREGRRPRLLVAKMGQDGHDRGAKVIATGF
ADLGFDVDIGPLFQTPREVAQQAVDADVHAVGVSTLAAGHKTLVPELIKELNSLGRPD
ILVMCGGVIPPQDYEFLFEVGVSNVFGPGTRIPKAAVQVLDDIEKCLEKKQQSV |

II. Modified Polynucleotides

The disclosure also includes a modified polynucleotide comprising the polynucleotide described herein, i.e., a polynucleotide comprising an ORF encoding an MCM polypeptide that contains polynucleotides that are chemically and/or structurally modified. When the polynucleotides of the present disclosure are chemically and/or structurally modified the polynucleotides can be referred to as "modified polynucleotides."

The present disclosure provides for modified nucleosides and nucleotides of a polynucleotide (e.g., RNA polynucleotides, such as mRNA polynucleotides). A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A nucleotide" refers to a nucleoside, including a phosphate group. Modified nucleotides can by synthesized by any useful method, such as, for example, chemically, enzymatically, or recombinantly, to include one or more modified or non-natural nucleosides. Polynucleotides can comprise a region or regions of linked nucleosides. Such regions can have variable backbone linkages. The linkages can be standard phosphodiester linkages, in which case the polynucleotides would comprise regions of nucleotides.

The modifications can be various distinct modifications. In some embodiments, the regions can contain one, two, or more (optionally different) nucleoside or nucleotide modifications. In some embodiments, a modified polynucleotide, introduced to a cell can exhibit reduced degradation in the cell, as compared to an unmodified polynucleotide.

Structural Modifications

In some embodiments, the polynucleotides of the present disclosure are structurally modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" can be chemically modified to "AT-5meC-G". The same polynucleotide can be structurally modified from "ATCG" to "ATCCG". Here, the dinucleotide "CC" has been inserted, resulting in a structural modification to the polynucleotide.

Chemical Modifications

In some embodiments, the polynucleotides of the present disclosure are chemically modified. As used herein in reference to a polynucleotide, the terms "chemical modification" or, as appropriate, "chemically modified" refer to modification with respect to adenosine (A), guanosine (G), uridine (U), thymidine (T) or cytidine (C) ribo- or deoxyribonucleosides in one or more of their position, pattern, percent or population. Generally, herein, these terms are not intended to refer to the ribonucleotide modifications in naturally occurring 5'-terminal mRNA cap moieties.

In some embodiments, the polynucleotides of the present disclosure can have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine or 5-methoxyuridine. In another embodiment, the polynucleotides can have a uniform chemical modification of two, three, or four of the same nucleoside type throughout the entire polynucleotide (such as all uridines and all cytosines, etc. are modified in the same way).

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker can be incorporated into polynucleotides of the present disclosure.

The skilled artisan will appreciate that, except where otherwise noted, polynucleotide sequences set forth in the instant application will recite "T"s in a representative DNA sequence but where the sequence represents RNA, the "T"s would be substituted for "U"s.

Modifications of polynucleotides (e.g., RNA polynucleotides, such as mRNA polynucleotides) that are useful in the compositions, methods and synthetic processes of the present disclosure include, but are not limited to the following nucleotides, nucleosides, and nucleobases: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deaza-adenosine; N1-methyl-adenosine; N6,N6 (dimethyl)adenine; N6-cis-hydroxy-isopentenyl-adenosine; α-thio-adenosine; 2 (amino)adenine; 2 (aminopropyl)adenine; 2 (methylthio) N6 (isopentenyl)adenine; 2-(alkyl)adenine; 2-(aminoalkyl)adenine; 2-(aminopropyl)adenine; 2-(halo)adenine; 2-(halo) adenine; 2-(propyl)adenine; 2'-Amino-2'-deoxy-ATP; 2'-Azido-2'-deoxy-ATP; 2'-Deoxy-2'-a-aminoadenosine TP; 2'-Deoxy-2'-a-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkynyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl)adenine; 8-(thiol)adenine; 8-azido-adenosine; aza adenine; deaza adenine; N6 (methyl)adenine; N6-(isopentyl)adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyladenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-a-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudo-iso-cytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl) cytosine; 5-(alkynyl)cytosine; 5-(halo)cytosine; 5-(propynyl)cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-aza-zebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-a-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azido-cytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thio-guanosine; 7-deaza-guanosine; 8-oxo-guanosine; N1-methyl-guanosine; α-thio-guanosine; 2 (propyl)guanine; 2-(alkyl)guanine; 2'-Amino-2'-deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-(alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-a-thiomethoxyguanosine TP; 2'-Deoxy-2'-b-aminoguanosine TP; 2'-Deoxy-2'-b-azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromoguanosine TP; 9-Deazaguanosine TP; N2-isobutyl-guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-ethyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine; 5-carboxymethylaminomethyluridine; 5-carboxymethyl-aminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methyluridine), 5-methoxyuridine; 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; N1-methyl-pseudo-uracil; N1-ethyl-pseudo-uracil; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2(thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio)pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl)pseudo-UTP; 1-Methyl-pseudo-UTP; 1-Ethyl-pseudo-UTP; 2 (thio)pseudouracil; 2' deoxy uridine; 2' fluorouridine; 2-(thio)uracil; 2,4-(dithio)psuedouracil; 2' methyl, 2'amino, 2'azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl)uracil; 4 (thio)pseudouracil; 4-(thio)pseudouracil; 4-(thio)uracil; 4-thiouracil; 5 (1,3-diazole-1-alkyl)uracil; 5 (2-aminopropyl)uracil; 5 (aminoalkyl)uracil; 5 (dimethylaminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio)uracil; 5 (methylaminomethyl)-4 (thio)uracil; 5 (propynyl)uracil; 5 (trifluoromethyl)uracil; 5-(2-aminopropyl)uracil; 5-(alkyl)-2-(thio)pseudouracil; 5-(alkyl)-2,4 (dithio)pseudouracil; 5-(alkyl)-4 (thio)pseudouracil; 5-(alkyl)pseudouracil; 5-(alkyl)uracil; 5-(alkynyl)uracil; 5-(allylamino)uracil; 5-(cyanoalkyl)uracil; 5-(dialkylaminoalkyl)uracil; 5-(dimethylaminoalkyl)uracil; 5-(guanidiniumalkyl)uracil; 5-(halo)uracil; 5-(1,3-diazole-1-alkyl)uracil; 5-(methoxy)uracil; 5-(methoxycarbonylmethyl)-2-(thio)uracil; 5-(methoxycarbonyl-methyl)uracil; 5-(methyl) 2(thio)uracil; 5-(methyl) 2,4 (dithio)uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4(dithio)uracil; 5-(methylaminomethyl)-4-(thio)uracil; 5-(propynyl)uracil; 5-(trifluoromethyl)uracil; 5-aminoallyl-uridine; 5-bromo-uridine; 5-iodo-uridine; 5-uracil; 6 (azo)uracil; 6-(azo)uracil; 6-aza-uridine; allyamino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-deaza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (+)1-(2-Hydroxypropyl)pseudouridine TP; (2R)-1-(2-Hydroxypropyl)pseudouridine TP; (2S)-1-(2-Hydroxypropyl)pseudouridine TP; (E)-5-(2-Bromo-vinyl)ara-uridine TP; (E)-5-(2-Bromo-vinyl)uridine TP; (Z)-5-(2-Bromo-vinyl)ara-uridine TP; (Z)-5-(2-Bromo-vinyl)uridine TP; 1-(2,2,2-Trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl)pseudo-UTP; 1-(2-Amino-2-carboxyethyl)pseudo-UTP; 1-(2-Amino-ethyl)pseudo-UTP; 1-(2-Hydroxyethyl)pseudouridine TP; 1-(2-Methoxyethyl)pseudouridine TP; 1-(3,4-Bis-trifluoromethoxybenzyl)pseudouridine TP; 1-(3,4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl)pseudo-UTP; 1-(4-Amino-butyl)pseudo-UTP; 1-(4-Amino-phenyl)pseudo-UTP; 1-(4-Azidobenzyl)pseudouridine TP; 1-(4-Bromobenzyl)pseudouridine TP; 1-(4-Chlorobenzyl)pseudouridine TP; 1-(4-Fluorobenzyl)pseudouridine TP; 1-(4-Iodobenzyl)pseudouridine TP; 1-(4-Methanesulfonyl-benzyl)pseudouridine TP; 1-(4-Methoxybenzyl)pseudouridine TP; 1-(4-Methoxy-benzyl)pseudo-UTP; 1-(4-Methoxyphenyl)pseudo-UTP; 1-(4-Methylbenzyl)pseudouridine TP; 1-(4-Methyl-benzyl)pseudo-UTP; 1-(4-Nitrobenzyl)pseudouridine TP; 1-(4-Nitro-benzyl)pseudo-UTP; 1(4-Nitro-phenyl)pseudo-UTP; 1-(4-Thiomethoxybenzyl)pseudouridine TP; 1-(4-Trifluoromethoxybenzyl)pseudouridine TP; 1-(4-Trifluoromethylbenzyl)pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-oxyoxy}-ethoxy)-propionyl]pseudouridine TP; 1-{3-[2-(2-Aminoethoxy)-ethoxy]-propionyl}pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homoallyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl)pseudo-UTP; 1-Methyl-6-amino-pseudo-UTP; 1-Methyl-6-azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylp seudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-UTP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-a-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenyl-pseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)-ethoxy}]propionic acid; Pseudouridine TP 1-[3-{2-(2-[2-{2 (2-ethoxy)-ethoxy}-ethoxy]-ethoxy)-ethoxy}]propionic acid; Pseudouridine TP 1-[3-{2-(2-[2-ethoxy]-ethoxy)-ethoxy}]propionic acid; Pseudouridine TP 1-[3-{2-(2-ethoxy)-ethoxy}] propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo- UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine; 1-(aza)-2-(thio)-3-(aza)-phenoxazin-1-yl: 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2 (amino)purine; 2,4,5-(trimethyl)phenyl; 2' methyl, 2'amino, 2'azido, 2'fluro-cytidine; 2' methyl, 2'amino, 2'azido, 2'fluro-adenine; 2'methyl, 2'amino, 2'azido, 2'fluro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl) isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1, 3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; 06-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-amino-pyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, the mRNA comprises at least one chemically modified nucleoside. In some embodiments, the at least one chemically modified nucleoside is selected from the group consisting of pseudouridine (v), 2-thiouridine (s2U), 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine, 2'-O-methyl uridine, 1-methyl-pseudouridine (m1ψ), 1-ethyl-pseudouridine (e1ψ), 5-methoxy-uridine (mo5U), 5-methyl-cytidine (m5C), α-thio-guanosine, α-thio-adenosine, 5-cyano uridine, 4'-thio uridine 7-deaza-adenine, 1-methyl-adenosine (m1A), 2-methyl-adenine (m2A), N6-methyl-adenosine (m6A), and 2,6-Diaminopurine, (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine, 2,8-dimethyl-adenosine, 2-geranylthiouridine, 2-lysidine, 2-selenouridine, 3-(3-amino-3-carboxypropyl)-5,6-dihydrouridine, 3-(3-amino-3-carboxypropyl)pseudouridine, 3-methylpseudouridine, 5-(carboxyhydroxymethyl)-2'-O-methyluridine methyl ester, 5-aminomethyl-2-geranylthiouridine, 5-aminomethyl-2-selenouridine, 5-aminomethyluridine, 5-carbamoylhydroxymethyluridine, 5-carbamoylmethyl-2-thiouridine, 5-carboxymethyl-2-thiouridine, 5-carboxymethylaminomethyl-2-geranylthiouridine, 5-carboxymethylaminomethyl-2-selenouridine, 5-cyanomethyluridine, 5-hydroxycytidine, 5-methylaminomethyl-2-geranylthiouridine, 7-aminocarboxypropyl-demethylwyosine, 7-aminocarboxypropylwyosine, 7-aminocarboxypropylwyosine methyl ester, 8-methyladenosine, N4,N4-dimethylcytidine, N6-formyladenosine, N6-hydroxymethyladenosine, agmatidine, cyclic N6-threonylcarbamoyladenosine, glutamyl-queuosine, methylated undermodified hydroxywybutosine, N4,N4,2'-O-trimethylcytidine, geranylated 5-methylaminomethyl-2-thiouridine, geranylated 5-carboxymethylaminomethyl-2-thiouridine, Qbase, preQ0base, preQ1base, and two or more combinations thereof. In some embodiments, the at least one chemically modified nucleoside is selected from the group consisting of pseudouridine, 1-methyl-pseudouridine, 1-ethyl-pseudouridine, 5-methylcytosine, 5-methoxyuridine, and a combination thereof. In some embodiments, the polynucleotide (e.g., RNA polynucleotide, such as mRNA polynucleotide) includes a combination of at least two (e.g., 2, 3, 4 or more) of the aforementioned modified nucleobases.

Base Modifications

In certain embodiments, the chemical modification is at nucleobases in the polynucleotides (e.g., RNA polynucleotide, such as mRNA polynucleotide). In some embodiments, modified nucleobases in the polynucleotide (e.g., RNA polynucleotide, such as mRNA polynucleotide) are selected from the group consisting of 1-methyl-pseudouridine (m1ψ), 1-ethyl-pseudouridine (e1ψ), 5-methoxy-uridine (mo5U), 5-methyl-cytidine (m5C), pseudouridine (ψ), α-thio-guanosine and α-thio-adenosine. In some embodiments, the polynucleotide includes a combination of at least two (e.g., 2, 3, 4 or more) of the aforementioned modified nucleobases.

In some embodiments, the polynucleotide (e.g., RNA polynucleotide, such as mRNA polynucleotide) comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide (e.g., RNA polynucleotide, such as mRNA polynucleotide) comprises 1-ethyl-pseudouridine (e1ψ). In some embodiments, the polynucleotide (e.g., RNA polynucleotide, such as mRNA polynucleotide) comprises 1-methyl-pseudouridine (m1ψ) and 5-methyl-cytidine (m5C). In some embodiments, the polynucleotide (e.g., RNA polynucleotide, such as mRNA polynucleotide) comprises 1-ethyl-pseudouridine (e1ψ) and 5-methyl-cytidine (m5C). In some embodiments, the polynucleotide (e.g., RNA polynucleotide, such as mRNA polynucleotide) comprises 2-thiouridine (s2U). In some embodiments, the polynucleotide (e.g., RNA polynucleotide, such as mRNA polynucleotide) comprises 2-thiouridine and 5-methyl-cytidine (m5C). In some embodiments, the polynucleotide (e.g., RNA polynucleotide, such as mRNA polynucleotide) comprises methoxy-uridine (mo5U). In some embodiments, the polynucleotide (e.g., RNA polynucleotide, such as mRNA polynucleotide) comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine. In some embodiments, the polynucleotide (e.g., RNA polynucleotide, such as mRNA polynucleotide) comprises 2'-O-methyl uridine and 5-methyl-cytidine (m5C). In some embodiments, the polynucleotide (e.g., RNA polynucleotide, such as mRNA polynucleotide) comprises N6-methyl-adenosine (m6A). In some embodiments, the polynucleotide (e.g., RNA polynucleotide, such as mRNA polynucleotide) comprises N6-methyl-adenosine (m6A) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the chemically modified nucleosides in the open reading frame are selected from the group consisting of uridine, adenine, cytosine, guanine, and any combination thereof.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenine (m6A), and 2,6-Diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

In some embodiments, the nucleobase modified nucleotides in the polynucleotide (e.g., RNA polynucleotide, such as mRNA polynucleotide) are 5-methoxyuridine.

In some embodiments, the polynucleotide (e.g., RNA polynucleotide, such as mRNA polynucleotide) includes a combination of at least two (e.g., 2, 3, 4 or more) of modified nucleobases.

In some embodiments, at least 95% of a type of nucleobases (e.g., uracil) in a polynucleotide of the disclosure (e.g., an mRNA polynucleotide encoding MCM) are modified nucleobases. In some embodiments, at least 95% of uracil in a polynucleotide of the present disclosure (e.g., an mRNA polynucleotide encoding MCM) is 5-methoxyuracil.

In some embodiments, the polynucleotide (e.g., RNA polynucleotide, such as mRNA polynucleotide) comprises 5-methoxyuridine (5mo5U) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methoxyuridine, meaning that substantially all uridine residues in the mRNA sequence are replaced with 5-methoxyuridine. Similarly, a polynucleotide can be uniformly modified for any type of nucleoside residue present in the sequence by replacement with a modified residue such as any of those set forth above.

In some embodiments, the modified nucleobase is a modified cytosine.

In some embodiments, a modified nucleobase is a modified uracil. Example nucleobases and nucleosides having a modified uracil include 5-methoxyuracil.

In some embodiments, a modified nucleobase is a modified adenine.

In some embodiments, a modified nucleobase is a modified guanine.

In some embodiments, the nucleobases, sugar, backbone, or any combination thereof in the open reading frame encoding an MCM polypeptide are chemically modified by at least 10%, at least 20%, at least 30%, at least 40%, at least 50%, at least 60%, at least 70%, at least 80%, at least 90%, at least 95%, at least 99%, or 100%.

In some embodiments, the uridine nucleosides in the open reading frame encoding an MCM polypeptide are chemically modified by at least 10%, at least 20%, at least 30%, at least 40%, at least 50%, at least 60%, at least 70%, at least 80%, at least 90%, at least 95%, at least 99%, or 100%.

In some embodiments, the adenosine nucleosides in the open reading frame encoding an MCM polypeptide are chemically modified by at least 10%, at least 20%, at least 30%, at least 40%, at least 50%, at least 60%, at least 70%, at least 80%, at least 90%, at least 95%, at least 99%, or 100%.

In some embodiments, the cytidine nucleosides in the open reading frame encoding an MCM polypeptide are chemically modified by at least at least 10%, at least 20%, at least 30%, at least 40%, at least 50%, at least 60%, at least 70%, at least 80%, at least 90%, at least 95%, at least 99%, or 100%.

In some embodiments, the guanosine nucleosides in the open reading frame encoding an MCM polypeptide are chemically modified by at least at least 10%, at least 20%, at least 30%, at least 40%, at least 50%, at least 60%, at least 70%, at least 80%, at least 90%, at least 95%, at least 99%, or 100%.

In some embodiments, the polynucleotides can include any useful linker between the nucleosides. Such linkers, including backbone modifications, that are useful in the composition of the present disclosure include, but are not limited to the following: 3'-alkylene phosphonates, 3'-amino phosphoramidate, alkene containing backbones, aminoalkylphosphoramidates, aminoalkylphosphotriesters, boranophosphates, —$CH_2$—O—N($CH_3$)—$CH_2$—, —$CH_2$—N($CH_3$)—N($CH_3$)—$CH_2$—, —$CH_2$—NH—$CH_2$—, chiral phosphonates, chiral phosphorothioates, formacetyl and thioformacetyl backbones, methylene (methylimino), methylene formacetyl and thioformacetyl backbones, methyleneimino and methylenehydrazino backbones, morpholino linkages, —N($CH_3$)—$CH_2$—$CH_2$—, oligonucleosides with heteroatom internucleoside linkage, phosphinates, phosphoramidates, phosphorodithioates, phosphorothioate internucleoside linkages, phosphorothioates, phosphotriesters, PNA, siloxane backbones, sulfamate backbones, sulfide sulfoxide and sulfone backbones, sulfonate and sulfonamide backbones, thionoalkylphosphonates, thionoalkylphosphotriesters, and thionophosphoramidates.

Modifications on the Sugar

The modified nucleosides and nucleotides (e.g., building block molecules), which can be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), —O($CH_2CH_2O$)$_n$$CH_2CH_2$OR, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Patent Publication No. WO2013052523 and International Patent Application No. PCT/US2013/75177, the contents of each of which are incorporated herein by reference in its entirety.

Combinations of Modifications

The polynucleotides of the disclosure can include a combination of modifications to the sugar, the nucleobase, and/or the internucleoside linkage. These combinations can include any one or more modifications described herein.

Examples of modified nucleotides and modified nucleotide combinations are provided below in Table 4. These combinations of modified nucleotides can be used to form the polynucleotides of the disclosure. Unless otherwise noted, the modified nucleotides can be completely substituted for the natural nucleotides of the polynucleotides of the disclosure. As a non-limiting example, the natural nucleotide uridine can be substituted with a modified nucleoside described herein. In another non-limiting example, the natural nucleotide uridine can be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker can be incorporated into the polynucleotides of the disclosure and such modifications are taught in International Patent Publication No. WO2013052523 and International Patent Application No. PCT/US2013/75177, the contents of each of which are incorporated herein by reference in its entirety.

TABLE 4

Combinations

| Uracil | Cytosine | Adenine | Guanine |
|---|---|---|---|
| 5-methoxy-UTP | CTP | ATP | GTP |
| 5-Methoxy-UTP | N4Ac-CTP | ATP | GTP |
| 5-Methoxy-UTP | 5-Methyl-CTP | ATP | GTP |
| 5-Methoxy-UTP | 5-Trifluoromethyl-CTP | ATP | GTP |
| 5-Methoxy-UTP | 5-Hydroxymethyl-CTP | ATP | GTP |
| 5-Methoxy-UTP | 5-Bromo-CTP | ATP | GTP |
| 5-Methoxy-UTP | N4Ac-CTP | ATP | GTP |
| 5-Methoxy-UTP | CTP | ATP | GTP |
| 5-Methoxy-UTP | 5-Methyl-CTP | ATP | GTP |

TABLE 4-continued

Combinations

| Uracil | Cytosine | Adenine | Guanine |
|---|---|---|---|
| 5-Methoxy-UTP | 5-Trifluoromethyl-CTP | ATP | GTP |
| 5-Methoxy-UTP | 5-Hydroxymethyl-CTP | ATP | GTP |
| 5-Methoxy-UTP | 5-Bromo-CTP | ATP | GTP |
| 5-Methoxy-UTP | N4-Ac-CTP | ATP | GTP |
| 5-Methoxy-UTP | 5-Iodo-CTP | ATP | GTP |
| 5-Methoxy-UTP | 5-Bromo-CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | CTP | ATP | GTP |
| 5-Methoxy-UTP | CTP | ATP | GTP |
| 5-Methoxy-UTP | CTP | ATP | GTP |
| 5-Methoxy-UTP | 5-Methyl-CTP | ATP | GTP |
| 5-Methoxy-UTP | 5-Methyl-CTP | ATP | GTP |
| 5-Methoxy-UTP | 5-Methyl-CTP | ATP | GTP |
| 5-Methoxy-UTP | CTP | Alpha-thio-ATP | GTP |
| 5-Methoxy-UTP | 5-Methyl-CTP | Alpha-thio-ATP | GTP |
| 5-Methoxy-UTP | CTP | ATP | Alpha-thio-GTP |
| 5-Methoxy-UTP | 5-Methyl-CTP | ATP | Alpha-thio-GTP |
| 5-Methoxy-UTP | CTP | N6-Me-ATP | GTP |
| 5-Methoxy-UTP | 5-Methyl-CTP | N6-Me-ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | 5-Ethyl-CTP | ATP | GTP |
| 5-Methoxy-UTP | 5-Methoxy-CTP | ATP | GTP |
| 5-Methoxy-UTP | 5-Ethynyl-CTP | ATP | GTP |
| 5-Methoxy-UTP | CTP | ATP | GTP |
| 5-Methoxy-UTP | 5-Methyl-CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% 1-Methyl-pseudo-UTP | 5-Methyl-CTP | ATP | GTP |
| 50% 5-Methoxy-UTP + 50% 1-Methyl-pseudo-UTP | 5-Methyl-CTP | ATP | GTP |
| 25% 5-Methoxy-UTP + 75% 1- | 5-Methyl-CTP | ATP | GTP |

TABLE 4-continued

| Uracil | Cytosine | Adenine | Guanine |
|---|---|---|---|
| Methyl-pseudo-UTP | | | |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% 1-Methyl-pseudo-UTP | 75% 5-Methyl-CTP + 25% CTP | ATP | GTP |
| 75% 5-Methoxy-UTP + 25% 1-Methyl-pseudo-UTP | 50% 5-Methyl-CTP + 50% CTP | ATP | GTP |
| 75% 5-Methoxy-UTP + 25% 1-Methyl-pseudo-UTP | 25% 5-Methyl-CTP + 75% CTP | ATP | GTP |
| 50% 5-Methoxy-UTP + 50% 1-Methyl-pseudo-UTP | 75% 5-Methyl-CTP + 25% CTP | ATP | GTP |
| 50% 5-Methoxy-UTP + 50% 1-Methyl-pseudo-UTP | 50% 5-Methyl-CTP + 50% CTP | ATP | GTP |
| 50% 5-Methoxy-UTP + 50% 1-Methyl-pseudo-UTP | 25% 5-Methyl-CTP + 75% CTP | ATP | GTP |
| 25% 5-Methoxy-UTP + 75% 1-Methyl-pseudo-UTP | 75% 5-Methyl-CTP + 25% CTP | ATP | GTP |
| 25% 5-Methoxy-UTP + 75% 1-Methyl-pseudo-UTP | 50% 5-Methyl-CTP + 50% CTP | ATP | GTP |
| 25% 5-Methoxy-UTP + 75% 1-Methyl-pseudo-UTP | 25% 5-Methyl-CTP + 75% CTP | ATP | GTP |
| 75% 5-Methoxy-UTP + 25% 1-Methyl-pseudo-UTP | CTP | ATP | GTP |
| 50% 5-Methoxy-UTP + 50% 1-Methyl-pseudo-UTP | CTP | ATP | GTP |
| 25% 5-Methoxy-UTP + 75% 1-Methyl-pseudo-UTP | CTP | ATP | GTP |
| 5-methoxy-UTP | CTP | ATP | GTP |
| 5-methoxy-UTP | CTP | ATP | GTP |
| 5-methoxy-UTP | 5-Methyl-CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | CTP | ATP | GTP |
| 5-Methoxy-UTP | 5-Methyl-CTP | ATP | GTP |
| 75% 5-Methoxy-UTP + 25% UTP | 5-Methyl-CTP | ATP | GTP |
| 50% 5-Methoxy-UTP + 50% UTP | 5-Methyl-CTP | ATP | GTP |
| 25% 5-Methoxy-UTP + 75% UTP | 5-Methyl-CTP | ATP | GTP |
| 5-Methoxy-UTP | 75% 5-Methyl-CTP + 25% CTP | ATP | GTP |
| 5-Methoxy-UTP | 50% 5-Methyl-CTP + 50% CTP | ATP | GTP |
| 5-Methoxy-UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 75% 5-Methoxy-UTP + 25% UTP | 50% 5-Methyl-CTP + 50% CTP | ATP | GTP |
| 75% 5-Methoxy-UTP + 25% UTP | 25% 5-Methyl-CTP + 75% CTP | ATP | GTP |
| 50% 5-Methoxy-UTP + 50% UTP | 75% 5-Methyl-CTP + 25% CTP | ATP | GTP |
| 50% 5-Methoxy-UTP + 50% UTP | 50% 5-Methyl-CTP + 50% CTP | ATP | GTP |
| 50% 5-Methoxy-UTP + 50% UTP | 25% 5-Methyl-CTP + 75% CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | CTP | ATP | GTP |
| 50% 5-Methoxy-UTP + 50% UTP | CTP | ATP | GTP |
| 25% 5-Methoxy-UTP + 75% UTP | CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |

TABLE 4-continued

| Combinations | | | |
|---|---|---|---|
| Uracil | Cytosine | Adenine | Guanine |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | CTP | ATP | GTP |
| 25% 5-Methoxy-UTP + 75% UTP | 75% 5-Methyl-CTP + 25% CTP | ATP | GTP |
| 25% 5-Methoxy-UTP + 75% UTP | 50% 5-Methyl-CTP + 50% CTP | ATP | GTP |
| 25% 5-Methoxy-UTP + 75% UTP | 25% 5-Methyl-CTP + 75% CTP | ATP | GTP |
| 75% 5-Methoxy-UTP + 25% UTP | 75% 5-Methyl-CTP + 25% CTP | ATP | GTP |
| 5-Methoxy-UTP | 5-Fluoro-CTP | ATP | GTP |
| 5-Methoxy-UTP | 5-Phenyl-CTP | ATP | GTP |
| 5-Methoxy-UTP | N4-Bz-CTP | ATP | GTP |
| 5-Methoxy-UTP | CTP | N6-Isopentenyl-ATP | GTP |
| 5-Methoxy-UTP | N4-Ac-CTP | ATP | GTP |
| 25% 5-Methoxy-UTP + 75% UTP | 25% N4-Ac-CTP + 75% CTP | ATP | GTP |
| 25% 5-Methoxy-UTP + 75% UTP | 75% N4-Ac-CTP + 25% CTP | ATP | GTP |
| 75% 5-Methoxy-UTP + 25% UTP | 25% N4-Ac-CTP + 75% CTP | ATP | GTP |
| 75% 5-Methoxy-UTP + 25% UTP | 75% N4-Ac-CTP + 25% CTP | ATP | GTP |
| 5-Methoxy-UTP | 5-Hydroxymethyl-CTP | ATP | GTP |
| 25% 5-Methoxy-UTP + 75% UTP | 25% 5-Hydroxymethyl-CTP + 75% CTP | ATP | GTP |
| 25% 5-Methoxy-UTP + 75% UTP | 75% 5-Hydroxymethyl-CTP + 25% CTP | ATP | GTP |
| 75% 5-Methoxy-UTP + 25% UTP | 25% 5-Hydroxymethyl-CTP + 75% CTP | ATP | GTP |
| 75% 5-Methoxy-UTP + 25% UTP | 75% 5-Hydroxymethyl-CTP + 25% CTP | ATP | GTP |
| 5-Methoxy-UTP | N4-Methyl CTP | ATP | GTP |
| 25% 5-Methoxy-UTP + 75% UTP | 25% N4-Methyl CTP + 75% CTP | ATP | GTP |
| 25% 5-Methoxy-UTP + 75% UTP | 75% N4-Methyl CTP + 25% CTP | ATP | GTP |
| 75% 5-Methoxy-UTP + 25% UTP | 25% N4-Methyl CTP + 75% CTP | ATP | GTP |
| 75% 5-Methoxy-UTP + 25% UTP | 75% N4-Methyl CTP + 25% CTP | ATP | GTP |
| 5-Methoxy-UTP | 5-Trifluoromethyl-CTP | ATP | GTP |
| 25% 5-Methoxy-UTP + 75% UTP | 25% 5-Trifluoromethyl-CTP + 75% CTP | ATP | GTP |
| 25% 5-Methoxy-UTP + 75% UTP | 75% 5-Trifluoromethyl-CTP + 25% CTP | ATP | GTP |
| 75% 5-Methoxy-UTP + 25% UTP | 25% 5-Trifluoromethyl-CTP + 75% CTP | ATP | GTP |
| 75% 5-Methoxy-UTP + 25% UTP | 75% 5-Trifluoromethyl-CTP + 25% CTP | ATP | GTP |
| 5-Methoxy-UTP | 5-Bromo-CTP | ATP | GTP |
| 25% 5-Methoxy-UTP + 75% UTP | 25% 5-Bromo-CTP + 75% CTP | ATP | GTP |
| 25% 5-Methoxy-UTP + 75% UTP | 75% 5-Bromo-CTP + 25% CTP | ATP | GTP |
| 75% 5-Methoxy-UTP + 25% UTP | 25% 5-Bromo-CTP + 75% CTP | ATP | GTP |
| 75% 5-Methoxy-UTP + 25% UTP | 75% 5-Bromo-CTP + 25% CTP | ATP | GTP |
| 5-Methoxy-UTP | 5-Iodo-CTP | ATP | GTP |
| 25% 5-Methoxy-UTP + 75% UTP | 25% 5-Iodo-CTP + 75% CTP | ATP | GTP |
| 25% 5-Methoxy-UTP + 75% UTP | 75% 5-Iodo-CTP + 25% CTP | ATP | GTP |
| 75% 5-Methoxy-UTP + 25% UTP | 25% 5-Iodo-CTP + 75% CTP | ATP | GTP |
| 75% 5-Methoxy-UTP + 25% UTP | 75% 5-Iodo-CTP + 25% CTP | ATP | GTP |
| 5-Methoxy-UTP | 5-Ethyl-CTP | ATP | GTP |
| 25% 5-Methoxy-UTP + 75% UTP | 25% 5-Ethyl-CTP + 75% CTP | ATP | GTP |

TABLE 4-continued

| Combinations | | | |
|---|---|---|---|
| Uracil | Cytosine | Adenine | Guanine |
| 25% 5-Methoxy-UTP + 75% UTP | 75% 5-Ethyl-CTP + 25% CTP | ATP | GTP |
| 75% 5-Methoxy-UTP + 25% UTP | 25% 5-Ethyl-CTP + 75% CTP | ATP | GTP |
| 75% 5-Methoxy-UTP + 25% UTP | 75% 5-Ethyl-CTP + 25% CTP | ATP | GTP |
| 5-Methoxy-UTP | 5-Methoxy-CTP | ATP | GTP |
| 25% 5-Methoxy-UTP + 75% UTP | 25% 5-Methoxy-CTP + 75% CTP | ATP | GTP |
| 25% 5-Methoxy-UTP + 75% UTP | 75% 5-Methoxy-CTP + 25% CTP | ATP | GTP |
| 75% 5-Methoxy-UTP + 25% UTP | 25% 5-Methoxy-CTP + 75% CTP | ATP | GTP |
| 75% 5-Methoxy-UTP + 25% UTP | 75% 5-Methoxy-CTP + 25% CTP | ATP | GTP |
| 5-Methoxy-UTP | 5-Ethynyl-CTP | ATP | GTP |
| 25% 5-Methoxy-UTP + 75% UTP | 25% 5-Ethynyl-CTP + 75% CTP | ATP | GTP |
| 25% 5-Methoxy-UTP + 75% UTP | 75% 5-Ethynyl-CTP + 25% CTP | ATP | GTP |
| 75% 5-Methoxy-UTP + 25% UTP | 25% 5-Ethynyl-CTP + 75% CTP | ATP | GTP |
| 75% 5-Methoxy-UTP + 25% UTP | 75% 5-Ethynyl-CTP + 25% CTP | ATP | GTP |
| 5-Methoxy-UTP | 5-Pseudo-iso-CTP | ATP | GTP |
| 25% 5-Methoxy-UTP + 75% UTP | 25% 5-Pseudo-iso-CTP + 75% CTP | ATP | GTP |
| 25% 5-Methoxy-UTP + 75% UTP | 75% 5-Pseudo-iso-CTP + 25% CTP | ATP | GTP |
| 75% 5-Methoxy-UTP + 25% UTP | 25% 5-Pseudo-iso-CTP + 75% CTP | ATP | GTP |
| 75% 5-Methoxy-UTP + 25% UTP | 75% 5-Pseudo-iso-CTP + 25% CTP | ATP | GTP |
| 5-Methoxy-UTP | 5-Formyl-CTP | ATP | GTP |
| 25% 5-Methoxy-UTP + 75% UTP | 25% 5-Formyl-CTP + 75% CTP | ATP | GTP |
| 25% 5-Methoxy-UTP + 75% UTP | 75% 5-Formyl-CTP + 25% CTP | ATP | GTP |
| 75% 5-Methoxy-UTP + 25% UTP | 25% 5-Formyl-CTP + 75% CTP | ATP | GTP |
| 75% 5-Methoxy-UTP + 25% UTP | 75% 5-Formyl-CTP + 25% CTP | ATP | GTP |
| 5-Methoxy-UTP | 5-Aminoallyl-CTP | ATP | GTP |
| 25% 5-Methoxy-UTP + 75% UTP | 25% 5-Aminoallyl-CTP + 75% CTP | ATP | GTP |
| 25% 5-Methoxy-UTP + 75% UTP | 75% 5-Aminoallyl-CTP + 25% CTP | ATP | GTP |
| 75% 5-Methoxy-UTP + 25% UTP | 25% 5-Aminoallyl-CTP + 75% CTP | ATP | GTP |
| 75% 5-Methoxy-UTP + 25% UTP | 75% 5-Aminoallyl-CTP + 25% CTP | ATP | GTP |

III. Polynucleotide Architecture

Traditionally, the basic components of an mRNA molecule include at least a coding region, a 5'UTR, a 3'UTR, a 5' cap and a poly-A tail. The polynucleotides of the present disclosure can function as mRNA but are distinguished from wild-type mRNA in their functional and/or structural design features that serve, e.g., to overcome existing problems of effective polypeptide production using nucleic-acid based therapeutics.

In Vitro Transcribed Polynucleotides

The disclosure also includes an in vitro transcribed polynucleotide comprising the polynucleotide described herein, i.e., a polynucleotide comprising an ORF encoding an MCM polypeptide.

Polynucleotides which are made using only in vitro transcription (IVT) enzymatic synthesis methods are referred to as "IVT polynucleotides." Methods of making IVT polynucleotides are known in the art and are described, e.g., in International Publication Nos. WO2013151666, WO2013151667, WO2013151668, WO2013151663, WO2013151669, WO2013151670, WO2013151664, WO2013151665, WO2013151671, WO2013151672 and WO2013151736; the contents of each of which are herein incorporated by reference in their entireties.

The shortest length of the first region of the primary construct of the IVT polynucleotide can be the length of a nucleic acid sequence that is sufficient to encode for MCM, a fragment thereof, or variant thereof. The length of the first region of the primary construct of the IVT polynucleotide encoding the polypeptide of interest can be greater than about 30 nucleotides in length (e.g., at least or greater than about 2,154, 2,250, 2,500, and 3,000, 4,000, 4,100, 4,200, 4,300, 4,400, 4,500, 4,600, 4,700, 4,800, 4,900, 5,000, 5,100, 5,200, 5,300, 5,400, 5,500, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the first and second flanking regions of the IVT polynucleotide can range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, 900, 1,000, 1,500, 2,000, 2,500, 3,000, 3,500, 4,000, 4,500, 5,000, 5,500 nucleotides or at least 30, 40, 45, 50, 55, 60, 70, 80, 90, 100, 120, 140, 160, 180, 200, 250, 300, 350, 400, 450, 500, 600, 700, 800, 900, 1,000, 1,500, 2,000, 2,500, 3,000, 3,500, 4,000, 4,500, 5,000, 5,500 nucleotides).

In some embodiments, the tailing sequence of the IVT polynucleotide can range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length can be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides and 160 nucleotides are functional.

In some embodiments, the capping region of the IVT polynucleotide can comprise a single cap or a series of nucleotides forming the cap. In this embodiment the capping region can be from 1 to 10, e.g., 2-9, 3-8, 4-7, 1-5, 5-10, or at least 2, or 10 or fewer nucleotides in length. In some embodiments, the cap is absent.

In some embodiments, the first and second operational regions of the IVT polynucleotide can range from 3 to 40, e.g., 5-30, 10-20, 15, or at least 4, or 30 or fewer nucleotides in length and can comprise, in addition to a Start and/or Stop codon, one or more signal and/or restriction sequences.

In some embodiments, the IVT polynucleotides can be structurally modified or chemically modified. When the IVT polynucleotides are chemically and/or structurally modified, the polynucleotides can be referred to as "modified IVT polynucleotides."

In some embodiments, if the IVT polynucleotides are chemically modified they can have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine or 5-methoxyuridine. In another embodiment, the IVT polynucleotides can have a uniform chemical modification of two, three, or four of the same nucleoside type throughout the entire polynucleotide (such as all uridines and all cytosines, etc. are modified in the same way).

In some embodiments, the IVT polynucleotide can encode MCM and at least one additional peptide or polypeptide of interest. In another embodiment, the IVT polynucleotide can encode MCM and two or more peptides or polypeptides of interest. Non-limiting examples of peptides or polypeptides of interest include an enzyme and its substrate, a label and its binding molecule, a second messenger and its enzyme or the components of multimeric proteins or complexes.

In some embodiments, the IVT polynucleotide encodes an MCM protein or a functional fragment thereof. In some embodiments, the IVT polynucleotides of the disclosure comprise any one of the human MCM nucleic acid sequences selected from SEQ ID NOs: 1 to 207, 732 to 765, and 772. In some embodiments, the IVT polynucleotide encodes a human MCM or functional fragment thereof comprising at least one amino acid mutation from the wild type sequence. In some embodiments, the IVT polynucleotide encodes an MCM mutant comprising one or more of the point mutations V69, T499, H532, A598, and V671. In some embodiments, the expression of the encoded polypeptide is increased. In some embodiments, the IVT polynucleotide increases MCM expression levels in cells when introduced into those cells, e.g., by 20-50%, at least 20%, at least 25%, at least 30%, at least 35%, at least 40%, at least 45%, or at least 50%.

Chimeric Polynucleotide Architecture

The disclosure also includes a chimeric polynucleotide comprising the polynucleotide described herein, i.e., a polynucleotide comprising an ORF encoding an MCM polypeptide.

Polynucleotides which have portions or regions which differ in size and/or chemical modification pattern, chemical modification position, chemical modification percent or chemical modification population and combinations of the foregoing are known as "chimeric polynucleotides." A "chimera" according to the present disclosure is an entity having two or more incongruous or heterogeneous parts or regions. As used herein a "part" or "region" of a polynucleotide is defined as any portion of the polynucleotide which is less than the entire length of the polynucleotide. Chimeric polynucleotides which are modified mRNA molecules are termed "chimeric modified mRNA" or "chimeric mRNA."

Chimeric polynucleotides have portions or regions that differ in size and/or chemical modification pattern, chemical modification position, chemical modification percent or chemical modification population and combinations of the foregoing.

Examples of parts or regions, where the chimeric polynucleotide functions as an mRNA and encodes a polypeptide of interest include, but are not limited to, untranslated regions (UTRs, such as the 5' UTR or 3' UTR), coding regions, cap regions, polyA tail regions, start regions, stop regions, signal or target sequence regions, and combinations thereof.

In some embodiments, the chimeric polynucleotides of the disclosure have a structure comprising Formula I.

5'-[A$_n$]$_x$-L1-[B$_o$]$_y$-L2-[C$_p$]$_z$-L3 3'  Formula I wherein:
each of A and B independently comprise a region of linked nucleosides;
either A or B or both A and B encode MCM as described elsewhere herein;
C is an optional region of linked nucleosides;
at least one of regions A, B, or C is positionally modified, wherein said positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications;
n, o and p are independently an integer between 15-10,000, representing the number of nucleosides in regions A, B, and C, respectively;
x and y are independently 1-20;
z is 0-5;
L1 and L2 are independently optional linker moieties, said linker moieties being either nucleic acid based or non-nucleic acid based; and
L3 is an optional conjugate or an optional linker moiety, said linker moiety being either nucleic acid based or non-nucleic acid based.

In some embodiments, at least one of the regions of linked nucleosides of A can comprise a sequence of linked nucleosides that can function as a 5' untranslated region (UTR). The sequence of linked nucleosides can be a natural or synthetic 5' UTR. As a non-limiting example, the chimeric polynucleotide can encode MCM and the sequence of linked nucleosides of A can encode the native 5' UTR of the MCM protein or a non-heterologous 5' UTR such as, but not limited to a synthetic UTR.

In another embodiment, at least one of the regions of linked nucleosides of A can be a cap region. The cap region can be located 5' to a region of linked nucleosides of A functioning as a 5'UTR. The cap region can comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In some embodiments, the polynucleotide of the disclosure comprises a Cap1 5'UTR. In some embodiments, a polynucleotide comprises the Cap1 5'UTR, wherein the polynucleotide encodes human MCM or functional fragment thereof. In some embodiments, a polynucleotide comprising 5'UTR sequence, e.g., Cap1, for encoding an MCM protein as disclosed herein increases expression of MCM compared to polynucleotides encoding MCM comprising a different 5'UTR (e.g., Cap0, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 or Cap4). In some embodiments, polynucleotide comprising the Cap1 5'UTR, increases MCM expression levels in cells when introduced into those cells, e.g., by at least 20%, e.g., at least 20%, at least 25%, at least 35%, or at least 40%.

In some embodiments, at least one of the regions of linked nucleosides of C can comprise a sequence of linked nucleosides that can function as a 3' UTR. The sequence of linked nucleosides can be a natural or synthetic 3' UTR. As a non-limiting example, the chimeric polynucleotide can encode MCM and the sequence of linked nucleosides of C can encode the native 3' UTR of MCM or a non-heterologous 3' UTR such as, but not limited to a synthetic UTR.

In some embodiments, at least one of the regions of linked nucleosides of A comprises a sequence of linked nucleosides that functions as a 5' UTR and at least one of the regions of linked nucleosides of C comprises a sequence of linked nucleosides that functions as a 3' UTR. In some embodiments, the 5' UTR and the 3' UTR can be from the same or different species. In another embodiment, the 5' UTR and the 3' UTR can encode the native untranslated regions from different proteins from the same or different species.

Chimeric polynucleotides, including the parts or regions thereof, of the present disclosure can be classified as hemimers, gapmers, wingmers, or blockmers.

As used herein, a "hemimer" is a chimeric polynucleotide comprising a region or part that comprises half of one pattern, percent, position or population of a chemical modification(s) and half of a second pattern, percent, position or population of a chemical modification(s). Chimeric polynucleotides of the present disclosure can also comprise hemimer subregions. In some embodiments, a part or region is 50% of one and 50% of another.

In some embodiments, the entire chimeric polynucleotide can be 50% of one and 50% of the other. Any region or part of any chimeric polynucleotide of the disclosure can be a hemimer. Types of hemimers include pattern hemimers, population hemimers or position hemimers. By definition, hemimers are 50:50 percent hemimers.

As used herein, a "gapmer" is a chimeric polynucleotide having at least three parts or regions with a gap between the parts or regions. The "gap" can comprise a region of linked nucleosides or a single nucleoside that differs from the chimeric nature of the two parts or regions flanking it. The two parts or regions of a gapmer can be the same or different from each other.

As used herein, a "wingmer" is a chimeric polynucleotide having at least three parts or regions with a gap between the parts or regions. Unlike a gapmer, the two flanking parts or regions surrounding the gap in a wingmer are the same in degree or kind. Such similarity can be in the length of number of units of different modifications or in the number of modifications. The wings of a wingmer can be longer or shorter than the gap. The wing parts or regions can be 20, 30, 40, 50, 60 70, 80, 90 or 95% greater or shorter in length than the region that comprises the gap.

As used herein, a "blockmer" is a patterned polynucleotide where parts or regions are of equivalent size or number and type of modifications. Regions or subregions in a blockmer can be 50, 51, 52, 53, 54, 55, 56, 57, 58, 59, 60, 61 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 310, 320, 330, 340, 350, 360, 370, 380, 390, 400, 410, 420, 430, 440, 450, 460, 470, 480, 490 or 500, nucleosides long.

Chimeric polynucleotides, including the parts or regions thereof, of the present disclosure having a chemical modification pattern are referred to as "pattern chimeras." Pattern chimeras can also be referred to as blockmers. Pattern chimeras are those polynucleotides having a pattern of modifications within, across or among regions or parts.

Patterns of modifications within a part or region are those that start and stop within a defined region. Patterns of modifications across a part or region are those patterns that start in on part or region and end in another adjacent part or region. Patterns of modifications among parts or regions are those that begin and end in one part or region and are repeated in a different part or region, which is not necessarily adjacent to the first region or part.

The regions or subregions of pattern chimeras or blockmers can have simple alternating patterns such as ABAB [AB]n where each "A" and each "B" represent different chemical modifications (at least one of the base, sugar or backbone linker), different types of chemical modifications (e.g., naturally occurring and non-naturally occurring), different percentages of modifications or different populations of modifications. The pattern can repeat n number of times where n=3-300. Further, each A or B can represent from 1-2500 units (e.g., nucleosides) in the pattern. Patterns can also be alternating multiples such as AABBAABB[AABB]n (an alternating double multiple) or AAABBBAAABBB [AAABBB]n (an alternating triple multiple) pattern. The pattern can repeat n number of times where n=3-300.

Different patterns can also be mixed together to form a second order pattern. For example, a single alternating pattern can be combined with a triple alternating pattern to form a second order alternating pattern A'B'. One example would be [ABABAB][AAABBBAAABBB][ABABAB] [AAABBBAAABBB] [ABABAB][AAABBBAAABBB], where [ABABAB] is A' and [AAABBBAAABBB] is B'. In like fashion, these patterns can be repeated n number of times, where n=3-300.

Patterns can include three or more different modifications to form an ABCABC[ABC]n pattern. These three component patterns can also be multiples, such as AABBC-CAABBCC[AABBCC]n and can be designed as combinations with other patterns such as ABCABCAABBCCABCABCAABBCC, and can be higher order patterns.

Regions or subregions of position, percent, and population modifications need not reflect an equal contribution from each modification type. They can form series such as "1-2-3-4," "1-2-4-8," where each integer represents the number of units of a particular modification type. Alternatively, they can be odd only, such as "1-3-3-1-3-1-5" or even only "2-4-2-4-6-4-8" or a mixture of both odd and even number of units such as "1-3-4-2-5-7-3-3-4".

Pattern chimeras can vary in their chemical modification by degree (such as those described above) or by kind (e.g., different modifications).

Chimeric polynucleotides, including the parts or regions thereof, of the present disclosure having at least one region with two or more different chemical modifications of two or more nucleoside members of the same nucleoside type (A, C, G, T, or U) are referred to as "positionally modified"

chimeras. Positionally modified chimeras are also referred to herein as "selective placement" chimeras or "selective placement polynucleotides". As the name implies, selective placement refers to the design of polynucleotides that, unlike polynucleotides in the art where the modification to any A, C, G, T or U is the same by virtue of the method of synthesis, can have different modifications to the individual As, Cs, Gs, Ts or Us in a polynucleotide or region thereof. For example, in a positionally modified chimeric polynucleotide, there can be two or more different chemical modifications to any of the nucleoside types of As, Cs, Gs, Ts, or Us. There can also be combinations of two or more to any two or more of the same nucleoside type. For example, a positionally modified or selective placement chimeric polynucleotide can comprise 3 different modifications to the population of adenines in the molecule and also have 3 different modifications to the population of cytosines in the construct-all of which can have a unique, non-random, placement.

Chimeric polynucleotides, including the parts or regions thereof, of the present disclosure having a chemical modification percent are referred to as "percent chimeras." Percent chimeras can have regions or parts that comprise at least 1%, at least 2%, at least 5%, at least 8%, at least 10%, at least 20%, at least 30%, at least 40%, at least 50%, at least 60%, at least 70%, at least 80%, at least 90%, at least 95%, or at least 99% positional, pattern or population of modifications. Alternatively, the percent chimera can be completely modified as to modification position, pattern, or population. The percent of modification of a percent chimera can be split between naturally occurring and non-naturally occurring modifications.

Chimeric polynucleotides, including the parts or regions thereof, of the present disclosure having a chemical modification population are referred to as "population chimeras." A population chimera can comprise a region or part where nucleosides (their base, sugar or backbone linkage, or combination thereof) have a select population of modifications. Such modifications can be selected from functional populations such as modifications that induce, alter or modulate a phenotypic outcome. For example, a functional population can be a population or selection of chemical modifications that increase the level of a cytokine. Other functional populations can individually or collectively function to decrease the level of one or more cytokines. Use of a selection of these like-function modifications in a chimeric polynucleotide would therefore constitute a "functional population chimera." As used herein, a "functional population chimera" can be one whose unique functional feature is defined by the population of modifications as described above or the term can apply to the overall function of the chimeric polynucleotide itself. For example, as a whole the chimeric polynucleotide can function in a different or superior way as compared to an unmodified or non-chimeric polynucleotide.

It should be noted that polynucleotides that have a uniform chemical modification of all of any of the same nucleoside type or a population of modifications produced by mere downward titration of the same starting modification in all of any of the same nucleoside type, or a measured percent of a chemical modification of all any of the same nucleoside type but with random incorporation, such as where all uridines are replaced by a uridine analog, e.g., pseudouridine or 5-methoxyuridine, are not considered chimeric polynucleotides. Likewise, polynucleotides having a uniform chemical modification of two, three, or four of the same nucleoside type throughout the entire polynucleotide (such as all uridines and all cytosines, etc. are modified in the same way) are not considered chimeric polynucleotides. One example of a polynucleotide that is not chimeric is the canonical pseudouridine/5-methyl cytosine modified polynucleotide. These uniform polynucleotides are arrived at entirely via in vitro transcription (IVT) enzymatic synthesis; and due to the limitations of the synthesizing enzymes, they contain only one kind of modification at the occurrence of each of the same nucleoside type, i.e., adenosine (A), thymidine (T), guanosine (G), cytidine (C) or uridine (U), found in the polynucleotide. Such polynucleotides can be characterized as IVT polynucleotides.

The chimeric polynucleotides of the present disclosure can be structurally modified or chemically modified. When the chimeric polynucleotides of the present disclosure are chemically and/or structurally modified, the polynucleotides can be referred to as "modified chimeric polynucleotides."

In some embodiments, the chimeric polynucleotides can encode two or more peptides or polypeptides of interest. Such peptides or polypeptides of interest include an enzyme and its substrate, a label and its binding molecule, a second messenger and its enzyme, or the components of multimeric proteins or complexes.

The regions or parts of the chimeric polynucleotides can be separated by a linker or spacer moiety. Such linkers or spaces can be nucleic acid based or non-nucleosidic.

In some embodiments, the chimeric polynucleotides can include a sequence encoding a self-cleaving peptide described herein, such as, but not limited to, a 2 A peptide. The polynucleotide sequence of the 2 A peptide in the chimeric polynucleotide can be modified or sequence-optimized by the methods described herein and/or are known in the art.

Notwithstanding the foregoing, the chimeric polynucleotides of the present disclosure can comprise a region or part that is not positionally modified or not chimeric as defined herein. For example, a region or part of a chimeric polynucleotide can be uniformly modified at one or more A, T, C, G, or U, but the polynucleotides will not be uniformly modified throughout the entire region or part.

Regions or parts of chimeric polynucleotides can be, in some embodiments, from 15-10,000 nucleosides in length and, in some embodiments, a polynucleotide can have from 2-100 different regions or patterns of regions as described herein.

In some embodiments, chimeric polynucleotides encode one or more polypeptides of interest. In another embodiment, the chimeric polynucleotides are substantially non-coding. In another embodiment, the chimeric polynucleotides have both coding and non-coding regions and parts.

In some embodiments, regions or subregions of the polynucleotides can range from being absent to 500 nucleotides in length (e.g., at least 60, 70, 80, 90, 100, 110, 120, 130, 140, 150, 160, 170, 180, 190, 200, 250, 300, 350, 400, 450, or 500 nucleotides). Where the region is a polyA tail, the length can be determined in units of, or as a function of, polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides to about 160 nucleotides are functional. The chimeric polynucleotides of the present disclosure that function as an mRNA need not comprise a polyA tail.

In some embodiments of the present disclosure, chimeric polynucleotides that function as an mRNA have a capping region. The capping region can comprise a single cap or a series of nucleotides forming the cap. In this embodiment the capping region can be from 1 to 10, e.g., 2-9, 3-8, 4-7, 1-5, 5-10, or at least 2, or 10 or fewer nucleotides in length. In some embodiments, the cap is absent.

The present disclosure contemplates chimeric polynucleotides that are circular or cyclic. As the name implies circular polynucleotides are circular in nature meaning that the termini are joined in some fashion, whether by ligation, covalent bond, common association with the same protein or other molecule or complex or by hybridization.

Chimeric polynucleotides, formulations and compositions comprising chimeric polynucleotides, and methods of making, using and administering chimeric polynucleotides are also described in International Patent Application No. PCT/US2014/53907, the contents of which is incorporated by reference in its entirety.

In some embodiments, the chimeric polynucleotide encodes an MCM protein or a functional fragment thereof. In some embodiments, the chimeric polynucleotides of the disclosure comprise any one of the human MCM nucleic acid sequences selected from SEQ ID NOs: 1-207, 732-765, and 772. In some embodiments, the chimeric polynucleotide encodes a human MCM or functional fragment thereof comprising at least one amino acid mutation from the wild type sequence. In some embodiments, the chimeric polynucleotide encodes an MCM mutant comprising one or more of the point mutations V69, T499, H532, A598, and V671. In some embodiments, the expression of the encoded polypeptide is increased. In some embodiments, the chimeric polynucleotide increases MCM expression levels in cells when introduced into those cells, e.g., by 20-50%, at least 20%, at least 25%, at least 30%, at least 35%, at least 40%, at least 45%, or at least 50%.

Circular Polynucleotide Architecture

The disclosure also includes a circular polynucleotide comprising the polynucleotide described herein, i.e., a polynucleotide comprising an ORF encoding an MCM polypeptide.

Polynucleotides that are circular are known as "circular polynucleotides" or "circP." As used herein, "circular polynucleotides" or "circP" means a single stranded circular polynucleotide which acts substantially like, and has the properties of, an RNA. The term "circular" is also meant to encompass any secondary or tertiary configuration of the circP.

The present disclosure contemplates polynucleotides encoding MCM that are circular or cyclic. As the name implies circular polynucleotides are circular in nature meaning that the termini are joined in some fashion, whether by ligation, covalent bond, common association with the same protein or other molecule or complex or by hybridization.

The circular polynucleotides or circPs that encode at least one peptide or polypeptide of interest are known as circular RNAs or circRNA. As used herein, "circular RNA" or "circRNA" means a circular polynucleotide that can encode at least one peptide or polypeptide of interest.

The circPs that comprise at least one sensor sequence and do not encode a peptide or polypeptide of interest are known as circular sponges or circSP. As used herein, "circular sponges," "circular polynucleotide sponges" or "circSP" means a circular polynucleotide that comprises at least one sensor sequence and does not encode a polypeptide of interest.

As used herein, "sensor sequence" means a receptor or pseudo-receptor for endogenous nucleic acid binding molecules. Non-limiting examples of sensor sequences include, microRNA binding sites, microRNA seed sequences, microRNA binding sites without the seed sequence, transcription factor binding sites and artificial binding sites engineered to act as pseudo-receptors and portions and fragments thereof.

The circPs that comprise at least one sensor sequence and encode at least one peptide or polypeptide of interest are known as circular RNA sponges or circRNA-SP. As used herein, "circular RNA sponges" or "circRNA-SP" means a circular polynucleotide that comprises at least one sensor sequence and at least one region encoding at least one peptide or polypeptide of interest.

As used herein, the term "circular construct" refers to a circular polynucleotide transcript that can act substantially similar to and have properties of a RNA molecule. In some embodiments, the circular construct acts as an mRNA. If the circular construct encodes one or more peptides or polypeptides of interest (e.g., a circRNA or circRNA-SP) then the polynucleotide transcript retains sufficient structural and/or chemical features to allow the polypeptide of interest encoded therein to be translated. Circular constructs can be polynucleotides of the disclosure. When structurally or chemically modified, the construct can be referred to as a modified circP, modified circSP, modified circRNA or modified circRNA-SP.

Circular polynucleotides, formulations and compositions comprising circular polynucleotides, and methods of making, using and administering circular polynucleotides are also disclosed in International Patent Application No. PCT/US2014/53904 the contents of which is incorporated by reference in its entirety.

In some embodiments, the circular polynucleotide encodes an MCM protein or a functional fragment thereof. In some embodiments, the circular polynucleotides of the disclosure comprise any one of the human MCM nucleic acid selected from SEQ ID NOs: 1-207, 732-765, and 772. In some embodiments, the circular polynucleotide encodes a human MCM or functional fragment thereof comprising at least one amino acid mutation from the wild type sequence. In some embodiments, the circular polynucleotide encodes an MCM mutant comprising one or more of the point mutations V69, T499, H532, A598, and V671. In some embodiments, the expression of the encoded polypeptide is increased. In some embodiments, the circular polynucleotide increases MCM expression levels in cells when introduced into those cells, e.g., by 20-50%, at least 20%, at least 25%, at least 30%, at least 35%, at least 40%, at least 45%, or at least 50%.

Multimers of Polynucleotides

The disclosure also includes multimers of polynucleotides comprising the polynucleotide described herein, i.e., a polynucleotide comprising an ORF encoding an MCM polypeptide.

In some embodiments, multiple distinct chimeric polynucleotides and/or IVT polynucleotides can be linked together through the 3'-end using nucleotides that are modified at the 3'-terminus. Chemical conjugation can be used to control the stoichiometry of delivery into cells. For example, the glyoxylate cycle enzymes, isocitrate lyase and malate synthase, can be supplied into cells at a 1:1 ratio to alter cellular fatty acid metabolism. This ratio can be controlled by chemically linking chimeric polynucleotides and/or IVT polynucleotides using a 3'-azido terminated nucleotide on one polynucleotides species and a C5-ethynyl or alkynyl-containing nucleotide on the opposite polynucleotide species. The modified nucleotide is added post-transcriptionally using terminal transferase (New England Biolabs, Ipswich, Mass.) according to the manufacturer's protocol. After the addition of the 3'-modified nucleotide, the two polynucleotides species can be combined in an aqueous solution, in the presence or absence of copper, to form a new covalent linkage via a click chemistry mechanism as described in the literature.

In another example, more than two chimeric polynucleotides and/or IVT polynucleotides can be linked together using a functionalized linker molecule. For example, a functionalized saccharide molecule can be chemically modified to contain multiple chemical reactive groups (SH—, $NH_2$—, $N_3$, etc. . . . ) to react with the cognate moiety on a 3'-functionalized mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated chimeric polynucleotides and/or IVT polynucleotides.

In some embodiments, the chimeric polynucleotides and/or IVT polynucleotides can be linked together in a pattern. The pattern can be a simple alternating pattern such as $CD[CD]_x$ where each "C" and each "D" represent a chimeric polynucleotide, IVT polynucleotide, different chimeric polynucleotides or different IVT polynucleotides. The pattern can repeat x number of times, where x=1-300. Patterns can also be alternating multiples such as $CCDD[CCDD]_x$ (an alternating double multiple) or $CCCDDD[CCCDDD]_x$ (an alternating triple multiple) pattern. The alternating double multiple or alternating triple multiple can repeat x number of times, where x=1-300.

Conjugates and Combinations of Polynucleotides

The disclosure also includes conjugates and combinations of polynucleotides comprising the polynucleotide described herein, i.e., a polynucleotide comprising an ORF encoding an MCM polypeptide.

In order to further enhance protein production, polynucleotides of the present disclosure can be designed to be conjugated to other polynucleotides, dyes, or other agents.

Conjugation can result in increased stability and/or half-life and can be particularly useful in targeting the polynucleotides to specific sites in the cell, tissue or organism.

In some embodiments, the polynucleotides can be administered with, conjugated to or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

Bifunctional Polynucleotides

The disclosure also includes bifunctional polynucleotides comprising the polynucleotide described herein, i.e., a polynucleotide comprising an ORF encoding an MCM polypeptide.

In some embodiments of the disclosure are bifunctional polynucleotides (e.g., bifunctional IVT polynucleotides, bifunctional chimeric polynucleotides or bifunctional circular polynucleotides). As the name implies, bifunctional polynucleotides are those having or capable of at least two functions. These molecules are also by convention be referred to as multi-functional.

The multiple functionalities of bifunctional polynucleotides can be encoded by the RNA (the function cannot manifest until the encoded product is translated) or can be a property of the polynucleotide itself. It can be structural or chemical. Bifunctional modified polynucleotides can comprise a function that is covalently or electrostatically associated with the polynucleotides. Further, the two functions can be provided in the context of a complex of a chimeric polynucleotide and another molecule.

Bifunctional polynucleotides can encode peptides that are anti-proliferative. These peptides can be linear, cyclic, constrained or random coil. They can function as aptamers, signaling molecules, ligands or mimics or mimetics thereof. Anti-proliferative peptides can, as translated, be from 3 to 50 amino acids in length. They can be 5-40, 10-30, or approximately 15 amino acids long. They can be single chain, multichain or branched and can form complexes, aggregates or any multi-unit structure once translated.

Noncoding Polynucleotides

The disclosure also includes a noncoding polynucleotide comprising the polynucleotide described herein, i.e., a polynucleotide comprising an ORF encoding an MCM polypeptide.

The polynucleotides described herein can further comprise sequences that are partially or substantially not translatable, e.g., having a noncoding region. As one non-limiting example, the noncoding region can be the first region of the IVT polynucleotide or the circular polynucleotide. Alternatively, the noncoding region can be a region other than the first region. As another non-limiting example, the noncoding region can be the A, B and/or C region of the chimeric polynucleotide.

Such molecules are generally not translated, but can exert an effect on protein production by one or more of binding to and sequestering one or more translational machinery components such as a ribosomal protein or a transfer RNA (tRNA), thereby effectively reducing protein expression in the cell or modulating one or more pathways or cascades in a cell that in turn alters protein levels. The polynucleotide can contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA). Examples of such lncRNA molecules and RNAi constructs designed to target such lncRNA any of which can be encoded in the polynucleotides are disclosed in International Publication, WO2012/018881 A2, the contents of which are incorporated herein by reference in their entirety.

Cytotoxic Nucleosides

In some embodiments, the polynucleotides of the present disclosure (i.e., a polynucleotide comprising an ORF encoding an MCM polypeptide) can further incorporate one or more cytotoxic nucleosides.

Untranslated Regions (UTRs)

Untranslated regions (UTRs) are nucleic acid sections of a polynucleotide before a start codon (5'UTR) and after a stop codon (3'UTR) that are not translated. In some embodiments, a polynucleotide (e.g., a ribonucleic acid (RNA), e.g., a messenger RNA (mRNA)) of the disclosure comprising an open reading frame (ORF) encoding an MCM polypeptide further comprises UTR (e.g., a 5'UTR or functional fragment thereof, a 3'UTR or functional fragment thereof, or a combination thereof).

A UTR can be homologous or heterologous to the coding region in a polynucleotide. In some embodiments, the UTR is homologous to the ORF encoding the MCM polypeptide. In some embodiments, the UTR is heterologous to the ORF encoding the MCM polypeptide. In some embodiments, the polynucleotide comprises two or more 5'UTRs or functional fragments thereof, each of which have the same or different nucleotide sequences. In some embodiments, the polynucleotide comprises two or more 3'UTRs or functional fragments thereof, each of which have the same or different nucleotide sequences.

In some embodiments, the 5'UTR or functional fragment thereof, 3' UTR or functional fragment thereof, or any combination thereof is sequence optimized.

In some embodiments, the 5'UTR or functional fragment thereof, 3' UTR or functional fragment thereof, or any combination thereof comprises at least one chemically modified nucleobase, e.g., 5-methoxyuracil.

UTRs can have features that provide a regulatory role, e.g., increased or decreased stability, localization and/or translation efficiency. A polynucleotide comprising a UTR can be administered to a cell, tissue, or organism, and one or more regulatory features can be measured using routine methods. In some embodiments, a functional fragment of a 5'UTR or 3'UTR comprises one or more regulatory features of a full length 5' or 3' UTR, respectively.

Natural 5'UTRs bear features that play roles in translation initiation. They harbor signatures like Kozak sequences that are commonly known to be involved in the process by which the ribosome initiates translation of many genes. Kozak sequences have the consensus CCR(A/G)CCAUGG, where R is a purine (adenine or guanine) three bases upstream of the start codon (AUG), which is followed by another 'G'. 5'UTRs also have been known to form secondary structures that are involved in elongation factor binding.

By engineering the features typically found in abundantly expressed genes of specific target organs, one can enhance the stability and protein production of a polynucleotide. For example, introduction of 5'UTR of liver-expressed mRNA, such as albumin, serum amyloid A, Apolipoprotein A/B/E, transferrin, alpha fetoprotein, erythropoietin, or Factor VIII, can enhance expression of polynucleotides in hepatic cell lines or liver. Likewise, use of 5'UTR from other tissue-specific mRNA to improve expression in that tissue is possible for muscle (e.g., MyoD, Myosin, Myoglobin, Myogenin, Herculin), for endothelial cells (e.g., Tie-1, CD36), for myeloid cells (e.g., C/EBP, AML1, G-CSF, GM-CSF, CD11b, MSR, Fr-1, i-NOS), for leukocytes (e.g., CD45, CD18), for adipose tissue (e.g., CD36, GLUT4, ACRP30, adiponectin) and for lung epithelial cells (e.g., SP-A/B/C/D).

In some embodiments, UTRs are selected from a family of transcripts whose proteins share a common function, structure, feature or property. For example, an encoded polypeptide can belong to a family of proteins (i.e., that share at least one function, structure, feature, localization, origin, or expression pattern), which are expressed in a particular cell, tissue or at some time during development. The UTRs from any of the genes or mRNA can be swapped for any other UTR of the same or different family of proteins to create a new polynucleotide.

In some embodiments, the 5'UTR and the 3'UTR can be heterologous. In some embodiments, the 5'UTR can be derived from a different species than the 3'UTR. In some embodiments, the 3'UTR can be derived from a different species than the 5'UTR.

Co-owned International Patent Application No. PCT/US2014/021522 (Publ. No. WO/2014/164253, incorporated herein by reference in its entirety) provides a listing of exemplary UTRs that can be utilized in the polynucleotide of the present disclosure as flanking regions to an ORF.

Exemplary UTRs of the application include, but are not limited to, one or more 5'UTR and/or 3'UTR derived from the nucleic acid sequence of: a globin, such as an α- or β-globin (e.g., a *Xenopus*, mouse, rabbit, or human globin); a strong Kozak translational initiation signal; a CYBA (e.g., human cytochrome b-245 α polypeptide); an albumin (e.g., human albumin7); a HSD17B4 (hydroxysteroid (17-β) dehydrogenase); a virus (e.g., a tobacco etch virus (TEV), a Venezuelan equine encephalitis virus (VEEV), a Dengue virus, a cytomegalovirus (CMV) (e.g., CMV immediate early 1 (IE1)), a hepatitis virus (e.g., hepatitis B virus), a sindbis virus, or a PAV barley yellow dwarf virus); a heat shock protein (e.g., hsp70); a translation initiation factor (e.g., eIF4G); a glucose transporter (e.g., hGLUT1 (human glucose transporter 1)); an actin (e.g., human α or β actin); a GAPDH; a tubulin; a histone; a citric acid cycle enzyme; a topoisomerase (e.g., a 5'UTR of a TOP gene lacking the 5' TOP motif (the oligopyrimidine tract)); a ribosomal protein Large 32 (L32); a ribosomal protein (e.g., human or mouse ribosomal protein, such as, for example, rps9); an ATP synthase (e.g., ATP5A1 or the β subunit of mitochondrial H⁺-ATP synthase); a growth hormone e (e.g., bovine (bGH) or human (hGH)); an elongation factor (e.g., elongation factor 1 α1 (EEF1A1)); a manganese superoxide dismutase (MnSOD); a myocyte enhancer factor 2A (MEF2A); a β-F1-ATPase, a creatine kinase, a myoglobin, a granulocyte-colony stimulating factor (G-CSF); a collagen (e.g., collagen type I, alpha 2 (Col1A2), collagen type I, alpha 1 (Col1A1), collagen type VI, alpha 2 (Col6A2), collagen type VI, alpha 1 (Col6A1)); a ribophorin (e.g., ribophorin I (RPNI)); a low density lipoprotein receptor-related protein (e.g., LRP1); a cardiotrophin-like cytokine factor (e.g., Nnt1); calreticulin (Calr); a procollagen-lysine, 2-oxoglutarate 5-dioxygenase 1 (Plod1); and a nucleobindin (e.g., Nucb1).

Other exemplary 5' and 3' UTRs include, but are not limited to, those described in Karikó et al., Mol. Ther. 2008 16(11):1833-1840; Karikó et al., Mol. Ther. 2012 20(5):948-953; Karikó et al., Nucleic Acids Res. 2011 39(21):e142; Strong et al., Gene Therapy 1997 4:624-627; Hansson et al., J. Biol. Chem. 2015 290(9):5661-5672; Yu et al., Vaccine 2007 25(10):1701-1711; Cafri et al., Mol. Ther. 2015 23(8):1391-1400; Andries et al., Mol. Pharm. 2012 9(8):2136-2145; Crowley et al., Gene Ther. 2015 Jun. 30, doi:10.1038/gt.2015.68; Ramunas et al., FASEB J. 2015 29(5):1930-1939; Wang et al., Curr. Gene Ther. 2015 15(4):428-435; Holtkamp et al., Blood 2006 108(13):4009-4017; Kormann et al., Nat. Biotechnol. 2011 29(2):154-157; Poleganov et al., Hum. Gen. Ther. 2015 26(11):751-766; Warren et al., Cell Stem Cell 2010 7(5):618-630; Mandal and Rossi, Nat. Protoc. 2013 8(3):568-582; Holcik and Liebhaber, PNAS 1997 94(6):2410-2414; Ferizi et al., Lab Chip. 2015 15(17):3561-3571; Thess et al., Mol. Ther. 2015 23(9):1456-1464; Boros et al., PLoS One 2015 10(6):e0131141; Boros et al., J. Photochem. Photobiol. B. 2013 129:93-99; Andries et al., J. Control. Release 2015 217:337-344; Zinckgraf et al., Vaccine 2003 21(15):1640-9; Garneau et al., J. Virol. 2008 82(2):880-892; Holden and Harris, Virology 2004 329(1):119-133; Chiu et al., J. Virol. 2005 79(13):8303-8315; Wang et al., EMBO J. 1997 16(13):4107-4116; Al-Zoghaibi et al., Gene 2007 391(1-2):130-9; Vivinus et al., Eur. J. Biochem. 2001 268(7):1908-1917; Gan and Rhoads, J. Biol. Chem. 1996 271(2):623-626; Boado et al., J. Neurochem. 1996 67(4):1335-1343; Knirsch and Clerch, Biochem. Biophys. Res. Commun. 2000 272(1):164-168; Chung et al., Biochemistry 1998 37(46):16298-16306; Izquierdo and Cuevza, Biochem. J. 2000 346 Pt 3:849-855; Dwyer et al., J. Neurochem. 1996 66(2):449-458; Black et al., Mol. Cell. Biol. 1997 17(5):2756-2763; Izquierdo and Cuevza, Mol. Cell. Biol. 1997 17(9):5255-5268; U.S. Pat. Nos. 8,278,036; 8,748,089; 8,835,108; 9,012,219; US2010/0129877; US2011/0065103; US2011/0086904; US2012/0195936; US2014/020675; US2013/0195967; US2014/029490; US2014/0206753; WO2007/036366; WO2011/015347; WO2012/072096; WO2013/143555; WO2014/071963; WO2013/185067; WO2013/182623; WO2014/089486;

WO2013/185069; WO2014/144196; WO2014/152659; 2014/152673; WO2014/152940; WO2014/152774; WO2014/153052; WO2014/152966, WO2014/152513; WO2015/101414; WO2015/101415; WO2015/062738; and WO2015/024667; the contents of each of which are incorporated herein by reference in their entirety.

In some embodiments, the 5'UTR is selected from the group consisting of a β-globin 5'UTR; a 5'UTR containing a strong Kozak translational initiation signal; a cytochrome b-245 α polypeptide (CYBA) 5'UTR; a hydroxysteroid (17-β) dehydrogenase (HSD17B4) 5'UTR; a Tobacco etch virus (TEV) 5'UTR; a Venezuelen equine encephalitis virus (TEEV) 5'UTR; a 5' proximal open reading frame of rubella virus (RV) RNA encoding nonstructural proteins; a Dengue virus (DEN) 5'UTR; a heat shock protein 70 (Hsp70) 5'UTR; a eIF4G 5'UTR; a GLUT1 5'UTR; functional fragments thereof and any combination thereof.

In some embodiments, the 3'UTR is selected from the group consisting of a β-globin 3'UTR; a CYBA 3'UTR; an albumin 3'UTR; a growth hormone (GH) 3'UTR; a VEEV 3'UTR; a hepatitis B virus (HBV) 3'UTR; α-globin 3'UTR; a DEN 3'UTR; a PAV barley yellow dwarf virus (BYDV-PAV) 3'UTR; an elongation factor 1 α1 (EEF1A1) 3'UTR; a manganese superoxide dismutase (MnSOD) 3'UTR; a β subunit of mitochondrial H(+)-ATP synthase (β-mRNA) 3'UTR; a GLUT1 3'UTR; a MEF2A 3'UTR; a β-F1-ATPase 3'UTR; functional fragments thereof and combinations thereof.

Other exemplary UTRs include, but are not limited to, one or more of the UTRs, including any combination of UTRs, disclosed in WO2014/164253, the contents of which are incorporated herein by reference in their entirety. Shown in Table 21 of U.S. Provisional Application No. 61/775,509 and in Table 22 of U.S. Provisional Application No. 61/829,372, the contents of each are incorporated herein by reference in their entirety, is a listing start and stop sites for 5'UTRs and 3'UTRs. In Table 21, each 5'UTR (5'-UTR-005 to 5'-UTR 68511) is identified by its start and stop site relative to its native or wild-type (homologous) transcript (ENST; the identifier used in the ENSEMBL database).

Wild-type UTRs derived from any gene or mRNA can be incorporated into the polynucleotides of the disclosure. In some embodiments, a UTR can be altered relative to a wild type or native UTR to produce a variant UTR, e.g., by changing the orientation or location of the UTR relative to the ORF; or by inclusion of additional nucleotides, deletion of nucleotides, swapping or transposition of nucleotides. In some embodiments, variants of 5' or 3' UTRs can be utilized, for example, mutants of wild type UTRs, or variants wherein one or more nucleotides are added to or removed from a terminus of the UTR.

Additionally, one or more synthetic UTRs can be used in combination with one or more non-synthetic UTRs. See, e.g., Mandal and Rossi, Nat. Protoc. 2013 8(3):568-82, the contents of which are incorporated herein by reference in their entirety, and sequences available at www.addgene.org/Derrick_Rossi/. UTRs or portions thereof can be placed in the same orientation as in the transcript from which they were selected or can be altered in orientation or location. Hence, a 5' and/or 3' UTR can be inverted, shortened, lengthened, or combined with one or more other 5' UTRs or 3' UTRs.

In some embodiments, the polynucleotide comprises multiple UTRs, e.g., a double, a triple or a quadruple 5'UTR or 3'UTR. For example, a double UTR comprises two copies of the same UTR either in series or substantially in series. For example, a double beta-globin 3'UTR can be used (see US2010/0129877, the contents of which are incorporated herein by reference in its entirety).

Tables 5 and 6 provide a listing of exemplary UTRs that can be utilized in the polynucleotides of the present disclosure. Shown in Table 5 is a listing of a 5'-untranslated region of the disclosure. Variants of 5' UTRs can be utilized wherein one or more nucleotides are added or removed to the termini, including A, T, C or G.

TABLE 5

5'-Untranslated Regions

| 5' UTR Identifier | Name/ Description | Sequence | SEQ ID NO. |
|---|---|---|---|
| 5UTR-001 | Upstream UTR | GGGAAATAAGAGAGAAAAGAAGAGTAAGAAGAAATAT AAGAGCCACC | 215 |
| 5UTR-002 | Upstream UTR | GGGAGATCAGAGAGAAAAGAAGAGTAAGAAGAAATAT AAGAGCCACC | 216 |
| 5UTR-003 | Upstream UTR | GGAATAAAAGTCTCAACACAACATATACAAAACAAAC GAATCTCAAGCAATCAAGCATTCTACTTCTATTGCAG CAATTTAAATCATTTCTTTTAAAGCAAAAGCAATTTT CTGAAAATTTTCACCATTTACGAACGATAGCAAC | 217 |
| 5UTR-004 | Upstream UTR | GGGAGACAAGCUUGGCAUUCCGGUACUGUUGGUAAAG CCACC | 218 |
| 5UTR-005 | Upstream UTR | GGGAGATCAGAGAGAAAAGAAGAGTAAGAAGAAATAT AAGAGCCACC | 219 |
| 5UTR-006 | Upstream UTR | GGAATAAAAGTCTCAACACAACATATACAAAACAAAC GAATCTCAAGCAATCAAGCATTCTACTTCTATTGCAG CAATTTAAATCATTTCTTTTAAAGCAAAAGCAATTTT CTGAAAATTTTCACCATTTACGAACGATAGCAAC | 220 |
| 5UTR-007 | Upstream UTR | GGGAGACAAGCUUGGCAUUCCGGUACUGUUGGUAAAG CCACC | 221 |
| 5UTR-008 | Upstream UTR | GGGAATTAACAGAGAAAAGAAGAGTAAGAAGAAATAT AAGAGCCACC | 222 |

TABLE 5-continued

5'-Untranslated Regions

| 5' UTR Identifier | Name/ Description | Sequence | SEQ ID NO. |
|---|---|---|---|
| 5UTR-009 | Upstream UTR | GGGAAATTAGACAGAAAAGAAGAGTAAGAAGAAATAT AAGAGCCACC | 223 |
| 5UTR-010 | Upstream UTR | GGGAAATAAGAGAGTAAAGAACAGTAAGAAGAAATAT AAGAGCCACC | 224 |
| 5UTR-011 | Upstream UTR | GGGAAAAAAGAGAGAAAAGAAGACTAAGAAGAAATAT AAGAGCCACC | 225 |
| 5UTR-012 | Upstream UTR | GGGAAATAAGAGAGAAAAGAAGAGTAAGAAGATATAT AAGAGCCACC | 226 |
| 5UTR-013 | Upstream UTR | GGGAAATAAGAGACAAAACAAGAGTAAGAAGAAATAT AAGAGCCACC | 227 |
| 5UTR-014 | Upstream UTR | GGGAAATTAGAGAGTAAAGAACAGTAAGTAGAATTAA AAGAGCCACC | 228 |
| 5UTR-015 | Upstream UTR | GGGAAATAAGAGAGAATAGAAGAGTAAGAAGAAATAT AAGAGCCACC | 229 |
| 5UTR-016 | Upstream UTR | GGGAAATAAGAGAGAAAAGAAGAGTAAGAAGAAAATT AAGAGCCACC | 230 |
| 5UTR-017 | Upstream UTR | GGGAAATAAGAGAGAAAAGAAGAGTAAGAAGAAATTT AAGAGCCACC | 231 |
| 5UTR-018 | Upstream UTR | TCAAGCTTTTGGACCCTCGTACAGAAGCTAATACGAC TCACTATAGGGAAATAAGAGAGAAAAGAAGAGTAAGA AGAAATATAAGAGCCACC | 266 |
| 142-3p UTR-001 | Upstream UTR including miR142-3p | TGATAATAGTCCATAAAGTAGGAAACACTACAGCTGG AGCCTCGGTGGCCATGCTTCTTGCCCCTTGGGCCTCC CCCCAGCCCCTCCTCCCCTTCCTGCACCCGTACCCCC GTGGTCTTTGAATAAAGTCTGAGTGGGCGGC | 725 |
| 142-3p UTR-002 | Upstream UTR including miR142-3p | TGATAATAGGCTGGAGCCTCGGTGGCTCCATAAAGTA GGAAACACTACACATGCTTCTTGCCCCTTGGGCCTCC CCCCAGCCCCTCCTCCCCTTCCTGCACCCGTACCCCC GTGGTCTTTGAATAAAGTCTGAGTGGGCGGC | 726 |
| 142-3p UTR-003 | Upstream UTR including miR142-3p | TGATAATAGGCTGGAGCCTCGGTGGCCATGCTTCTTG CCCCTTCCATAAAGTAGGAAACACTACATGGGCCTCC CCCCAGCCCCTCCTCCCCTTCCTGCACCCGTACCCCC GTGGTCTTTGAATAAAGTCTGAGTGGGCGGC | 727 |
| 142-3p UTR-004 | Upstream UTR including miR142-3p | TGATAATAGGCTGGAGCCTCGGTGGCCATGCTTCTTG CCCCTTGGGCCTCCCCCCAGTCCATAAAGTAGGAAAC ACTACACCCCTCCTCCCCTTCCTGCACCCGTACCCCC GTGGTCTTTGAATAAAGTCTGAGTGGGCGGC | 728 |
| 142-3p UTR-005 | Upstream UTR including miR142-3p | TGATAATAGGCTGGAGCCTCGGTGGCCATGCTTCTTG CCCCTTGGGCCTCCCCCCAGCCCCTCCTCCCCTTCTC CATAAAGTAGGAAACACTACACTGCACCCGTACCCCC GTGGTCTTTGAATAAAGTCTGAGTGGGCGGC | 729 |
| 142-3p UTR-006 | Upstream UTR including miR142-3p | TGATAATAGGCTGGAGCCTCGGTGGCCATGCTTCTTG CCCCTTGGGCCTCCCCCCAGCCCCTCCTCCCCTTCCT GCACCCGTACCCCCTCCATAAAGTAGGAAACACTACA GTGGTCTTTGAATAAAGTCTGAGTGGGCGGC | 730 |
| 142-3p UTR-007 | Upstream UTR including miR142-3p | TGATAATAGGCTGGAGCCTCGGTGGCCATGCTTCTTG CCCCTTGGGCCTCCCCCCAGCCCCTCCTCCCCTTCCT GCACCCGTACCCCCGTGGTCTTTGAATAAAGTTCCAT AAAGTAGGAAACACTACACTGAGTGGGCGGC | 731 |

In a particular embodiment, the 5' UTR useful for the polynucleotides comprises SEQ ID NO: 266.

Shown in Table 6 is a listing of 3'-untranslated regions of the disclosure. Variants of 3' UTRs can be utilized wherein one or more nucleotides are added or removed to the termini, including A, T, C or G.

TABLE 6

3'-Untranslated Regions

| 3' UTR Identifier | Name/ Description | Sequence | SEQ ID NO. |
|---|---|---|---|
| 3UTR-001 | Creatine Kinase | GCGCCTGCCCACCTGCCACCGACTGCTGGAACCCAGCCAGTGG GAGGGCCTGGCCCACCAGAGTCCTGCTCCCTCACTCCTCGCC CGCCCCTGTCCCAGAGTCCCACCTGGGGGCTCTCTCCACCCT TCTCAGAGTTCCAGTTTCAACCAGAGTTCCAACCAATGGGCTC CATCCTCTGGATTCTGGCCAATGAAATATCTCCCTGGCAGGGT CCTCTTCTTTTCCCAGAGCTCCACCCCAACCAGGAGCTCTAGT TAATGGAGAGCTCCCAGCACACTCGGAGCTTGTGCTTTGTCTC CACGCAAAGCGATAAATAAAAGCATTGGTGGCCTTTGGTCTTT GAATAAAGCCTGAGTAGGAAGTCTAGA | 232 |
| 3UTR-002 | Myoglobin | GCCCCTGCCGCTCCCACCCCCACCCATCTGGGCCCCGGGTTCA AGAGAGAGCGGGGTCTGATCTCGTGTAGCCATATAGAGTTTGC TTCTGAGTGTCTGCTTTGTTTAGTAGAGGTGGGCAGGAGGAGC TGAGGGGCTGGGGCTGGGGTGTTGAAGTTGGCTTTGCATGCCC AGCGATGCGCCTCCCTGTGGGATGTCATCACCCTGGGAACCGG GAGTGGCCCTTGGCTCACTGTGTTCTGCATGGTTTGGATCTGA ATTAATTGTCCTTTCTTCTAAATCCCAACCGAACTTCTTCCAA CCTCCAAACTGGCTGTAACCCCAAATCCAAGCCATTAACTACA CCTGACAGTAGCAATTGTCTGATTAATCACTGGCCCCTTGAAG ACAGCAGAATGTCCCTTTGCAATGAGGAGGAGATCTGGGCTGG GCGGGCCAGCTGGGGAAGCATTTGACTATCTGGAACTTGTGTG TGCCTCCTCAGGTATGGCAGTGACTCACCTGGTTTTAATAAAA CAACCTGCAACATCTCATGGTCTTTGAATAAAGCCTGAGTAGG AAGTCTAGA | 233 |
| 3UTR-003 | α-actin | ACACACTCCACCTCCAGCACGCGACTTCTCAGGACGACGAATC TTCTCAATGGGGGGGCGGCTGAGCTCCAGCCACCCCGCAGTCA CTTTCTTTGTAACAACTTCCGTTGCTGCCATCGTAAACTGACA CAGTGTTTATAACGTGTACATACATTAACTTATTACCTCATTT TGTTATTTTTCGAAACAAAGCCCTGTGGAAGAAAATGGAAAAC TTGAAGAAGCATTAAAGTCATTCTGTTAAGCTGCGTAAATGGT CTTTGAATAAAGCCTGAGTAGGAAGTCTAGA | 234 |
| 3UTR-004 | Albumin | CATCACATTTAAAAGCATCTCAGCCTACCATGAGAATAAGAGA AAGAAAATGAAGATCAAAAGCTTATTCATCTGTTTTTCTTTTT CGTTGGTGTAAAGCCAACACCCTGTCTAAAAAACATAAATTTC TTTAATCATTTTGCCTCTTTTCTCTGTGCTTCAATTAATAAAA AATGGAAAGAATCTAATAGAGTGGTACAGCACTGTTATTTTTC AAAGATGTGTTGCTATCCTGAAAATTCTGTAGGTTCTGTGGAA GTTCCAGTGTTCTCTCTTATTCCACTTCGGTAGAGGATTTCTA GTTTCTTGTGGGCTAATTAAATAAATCATTAATACTCTTCTAA TGGTCTTTGAATAAAGCCTGAGTAGGAAGTCTAGA | 235 |
| 3UTR-005 | α-globin | GCTGCCTTCTGCGGGGCTTGCCTTCTGGCCATGCCCTTCTTCT CTCCCTTGCACCTGTACCTCTTGGTCTTTGAATAAAGCCTGAG TAGGAAGGCGGCCGCTCGAGCATGCATCTAGA | 236 |
| 3UTR-006 | G-CSF | GCCAAGCCCTCCCCATCCCATGTATTTATCTCTATTTAATATT TATGTCTATTTAAGCCTCATATTTAAAGACAGGGAAGAGCAGA ACGGAGCCCCAGGCCTCTGTGTCCTTCCCTGCATTTCTGAGTT TCATTCTCCTGCCTGTAGCAGTGAGAAAAAGCTCCTGTCCTCC CATCCCCTGGACTGGGAGGTAGATAGGTAAATACCAAGTATTT ATTACTATGACTGCTCCCCAGCCCTGGCTCTGCAATGGGCACT GGGATGAGCCGCTGTGAGCCCCTGGTCCTGAGGGTCCCCACCT GGGACCCTTGAGAGTATCAGGTCTCCCACGTGGGAGACAAGAA ATCCCTGTTTAATATTTAAACAGCAGTGTTCCCCATCTGGGTC CTTGCACCCCTCACTCTGGCCTCAGCCGACTGCACAGCGGCCC CTGCATCCCCTTGGCTGTGAGGCCCCTGGACAAGCAGAGGTGG CCAGAGCTGGGAGGCATGGCCCTGGGGTCCCACGAATTTGCTG GGGAATCTCGTTTTTCTTCTTAAGACTTTTGGGACATGGTTTG ACTCCCGAACATCACCGACGCGTCTCCTGTTTTTCTGGGTGGC CTCGGGACACCTGCCCTGCCCCCACGAGGGTCAGGACTGTGAC TCTTTTTAGGGCCAGGCAGGTGCCTGGACATTTGCCTTGCTGG ACGGGGACTGGGGATGTGGAGGGAGCAGACAGGAGGAATCAT GTCAGGCCTGTGTGTGAAAGGAAGCTCCACTGTCACCCTCCAC CTCTTCACCCCCCACTCACCAGTGTCCCCTCCACTGTCACATT GTAACTGAACTTCAGGATAATAAAGTGTTTGCCTCCATGGTCT TTGAATAAAGCCTGAGTAGGAAGGCGGCCGCTCGAGCATGCAT CTAGA | 237 |
| 3UTR-007 | Col1a2; collagen, type I, alpha 2 | ACTCAATCTAAATTAAAAAAGAAAGAAATTTGAAAAAACTTTC TCTTTGCCATTTCTTCTTCTTCTTTTTTAACTGAAAGCTGAAT CCTTCCATTTCTTCTGCACATCTACTTGCTTAAATTGTGGGCA AAAGAGAAAAAGAAGGATTGATCAGAGCATTGTGCAATACAGT | 238 |

TABLE 6-continued

3'-Untranslated Regions

| 3' UTR Identifier | Name/ Description | Sequence | SEQ ID NO. |
|---|---|---|---|
| | | TTCATTAACTCCTTCCCCCGCTCCCCCAAAAATTTGAATTTTT TTTTCAACACTCTTACACCTGTTATGGAAAATGTCAACCTTTG TAAGAAAACCAAAATAAAAATTGAAAAATAAAAACCATAAACA TTTGCACCACTTGTGGCTTTTGAATATCTTCCACAGAGGGAAG TTTAAAACCCAAACTTCCAAAGGTTTAAACTACCTCAAAACAC TTTCCCATGAGTGTGATCCACATTGTTAGGTGCTGACCTAGAC AGAGATGAACTGAGGTCCTTGTTTTGTTTTGTTCATAATACAA AGGTGCTAATTAATAGTATTTCAGATACTTGAAGAATGTTGAT GGTGCTAGAAGAATTTGAGAAGAAATACTCCTGTATTGAGTTG TATCGTGTGGTGTATTTTTTAAAAAATTTGATTTAGCATTCAT ATTTTCCATCTTATTCCCAATTAAAAGTATGCAGATTATTTGC CCAAATCTTCTTCAGATTCAGCATTTGTTCTTTGCCAGTCTCA TTTTCATCTTCTTCCATGGTTCCACAGAAGCTTTGTTTCTTGG GCAAGCAGAAAAATTAAATTGTACCTATTTTGTATATGTGAGA TGTTTAAATAAATTGTGAAAAAAATGAAATAAAGCATGTTTGG TTTTCCAAAAGAACATAT | |
| 3UTR-008 | Col6a2; collagen, type VI, alpha 2 | CGCCGCCGCCCGGGCCCCGCAGTCGAGGGTCGTGAGCCCACCC CGTCCATGGTGCTAAGCGGGCCCGGGTCCCACACGGCCAGCAC CGCTGCTCACTCGGACGACGCCCTGGGCCTGCACCTCTCCAGC TCCTCCCACGGGGTCCCCGTAGCCCCGGCCCCCGCCCAGCCCC AGGTCTCCCCAGGCCCTCCGCAGGCTGCCCGGCCTCCCTCCCC CTGCAGCCATCCCAAGGCTCCTGACCTACCTGGCCCCTGAGCT CTGGAGCAAGCCCTGACCCAATAAAGGCTTTGAACCCAT | 239 |
| 3UTR-009 | RPN1; ribophorin I | GGGGCTAGAGCCCTCTCCGCACAGCGTGGAGACGGGGCAAGGA GGGGGGTTATTAGGATTGGTGGTTTTGTTTTGCTTTGTTTAAA GCCGTGGGAAAATGGCACAACTTTACCTCTGTGGGAGATGCAA CACTGAGAGCCAAGGGGTGGGAGTTGGGATAATTTTTATATAA AGAAGTTTTTCCACTTTGAATTGCTAAAAGTGGCATTTTTCC TATGTGCAGTCACTCCTCTCATTTCTAAAATAGGGACGTGGCC AGGCACGGTGGCTCATGCCTGTAATCCCAGCACTTTGGGAGGC CGAGGCAGGCGGCTCACGAGGTCAGGAGATCGAGACTATCCTG GCTAACACGGTAAAACCCTGTCTCTACTAAAAGTACAAAAAAT TAGCTGGGCGTGGTGGTGGGCACCTGTAGTCCCAGCTACTCGG GAGGCTGAGGCAGGAGAAAGGCATGAATCCAAGAGGCAGAGCT TGCAGTGAGCTGAGATCACGCCATTGCACTCCAGCCTGGGCAA CAGTGTTAAGACTCTGTCTCAAATATAAATAAATAAATAAATA AATAAATAAATAAAAATAAAGCGAGATGTTGCCCTCAAA | 240 |
| 3UTR-010 | LRP1; low density lipoprotein receptor- related protein 1 | GGCCCTGCCCCGTCGGACTGCCCCCAGAAAGCCTCCTGCCCCC TGCCAGTGAAGTCCTTCAGTGAGCCCCTCCCCAGCCAGCCCTT CCCTGGCCCCGCCGGATGTATAAATGTAAAAATGAAGGAATTA CATTTTATATGTGAGCGAGCAAGCCGGCAAGCGAGCACGTAT TATTTCTCCATCCCCTCCCTGCCTGCTCCTTGGCACCCCCATG CTGCCTTCAGGGAGACAGGCAGGGAGGGCTTGGGGCTGCACCT CCTACCCTCCCACCAGAACGCACCCCACTGGGAGAGCTGGTGG TGCAGCCTTCCCCTCCCTGTATAAGACACTTTGCCAAGGCTCT CCCCTCTCGCCCCATCCCTGCTTGCCCGCTCCCACAGCTTCCT GAGGGCTAATTCTGGGAAGGGAGAGTTCTTTGCTGCCCCTGTC TGGAAGACGTGGCTCTGGGTGAGGTAGGCGGGAAAGGATGGAG TGTTTTAGTTCTTGGGGGAGGCCACCCCAAACCCCAGCCCCAA CTCCAGGGGCACCTATGAGATGGCCATGCTCAACCCCCCTCCC AGACAGGCCCTCCCTGTCTCCAGGGCCCCCACCGAGGTTCCCA GGGCTGGAGACTTCCTCTGGTAAACATTCCTCCAGCCTCCCCT CCCCTGGGGACGCCAAGGAGGTGGGCCACACCCAGGAAGGGAA AGCGGGCAGCCCCGTTTTGGGGACGTGAACGTTTTAATAATTT TTGCTGAATTCCTTTACAACTAAATAACACAGATATTGTTATA AATAAAATTGT | 241 |
| 3UTR-011 | Nnt1; cardiotrophin- like cytokine factor 1 | ATATTAAGGATCAAGCTGTTAGCTAATAATGCCACCTCTGCAG TTTGGGAACAGGCAAATAAAGTATCAGTATACATGGTGATGT ACATCTGTAGCAAAGCTCTTGGAGAAAATGAAGACTGAAGAAA GCAAAGCAAAAACTGTATAGAGAGATTTTTCAAAAGCAGTAAT CCCTCAATTTTAAAAAAGGATTGAAAATTCTAAATGTCTTTCT GTGCATATTTTTTGTGTTAGGAATCAAAAGTATTTTATAAAAG GAGAAAGAACAGCCTCATTTTAGATGTAGTCCTGTTGGATTTT TTATGCCTCCTCAGTAACCAGAAATGTTTTAAAAAACTAAGTG TTTAGGATTTCAAGACAACATTATACATGGCTCTGAAATATCT GACACAATGTAAACATTGCAGGCACCTGCATTTTATGTTTTTT TTTTCAACAAATGTGACTAATTTGAAACTTTTATGAACTTCTG AGCTGTCCCCTTGCAATTCAACCGCAGTTTGAATTAATCATAT CAAATCAGTTTTAATTTTTTAAATTGTACTTCAGAGTCTATAT TTCAAGGGCACATTTTCTCACTACTATTTTAATACATTAAAGG | 242 |

TABLE 6-continued

3'-Untranslated Regions

| 3' UTR Identifier | Name/ Description | Sequence | SEQ ID NO. |
|---|---|---|---|
| | | ACTAAATAATCTTTCAGAGATGCTGGAAACAAATCATTTGCTT TATATGTTTCATTAGAATACCAATGAAACATACAACTTGAAAA TTAGTAATAGTATTTTTGAAGATCCCATTTCTAATTGGAGATC TCTTTAATTTCGATCAACTTATAATGTGTAGTACTATATTAAG TGCACTTGAGTGGAATTCAACATTTGACTAATAAAATGAGTTC ATCATGTTGGCAAGTGATGTGGCAATTATCTCTGGTGACAAAA GAGTAAAATCAAATATTTCTGCCTGTTACAAATATCAAGGAAG ACCTGCTACTATGAAATAGATGACATTAATCTGTCTTCACTGT TTATAATACGGATGGATTTTTTTTCAAATCAGTGTGTGTTTTG AGGTCTTATGTAATTGATGACATTTGAGAGAAATGGTGGCTTT TTTTAGCTACCTCTTTGTTCATTTAAGCACCAGTAAAGATCAT GTCTTTTTATAGAAGTGTAGATTTTCTTTGTGACTTTGCTATC GTGCCTAAAGCTCTAAATATAGGTGAATGTGTGATGAATACTC AGATTATTTGTCTCTCTATATAATTAGTTTGGTACTAAGTTTC TCAAAAAATTATTAACACATGAAAGACAATCTCTAAACCAGAA AAAGAAGTAGTACAAATTTTGTTACTGTAATGCTCGCGTTTAG TGAGTTTAAAACACACAGTATCTTTTGGTTTTATAATCAGTTT CTATTTTGCTGTGCCTGAGATTAAGATCTGTGTATGTGTGTGT GTGTGTGTGTGCGTTTGTGTGTTAAAGCAGAAAAGACTTTTTT AAAAGTTTTAAGTGATAAATGCAATTTGTTAATTGATCTTAGA TCACTAGTAAACTCAGGGCTGAATTATACCATGTATATTCTAT TAGAAGAAAGTAAACACCATCTTTATTCCTGCCCTTTTTCTTC TCTCAAAGTAGTTGTAGTTATATCTAGAAAGAAGCAATTTTGA TTTCTTGAAAAGGTAGTTCCTGCACTCAGTTTAAACTAAAAAT AATCATACTTGGATTTTATTTATTTTTGTCATAGTAAAAATTT TAATTTATATATATTTTTATTTAGTATTATCTTATTCTTTGCT ATTTGCCAATCCTTTGTCATCAATTGTGTTAAATGAATTGAAA ATTCATGCCCTGTTCATTTTATTTTACTTTATTGGTTAGGATA TTTAAAGGATTTTGTATATATAATTTCTTAAATTAATATTCC AAAAGGTTAGTGGACTTAGATTATAAATTATGGCAAAAATCTA AAAACAACAAAAATGATTTTTATACATTCTATTTCATTATTCC TCTTTTTCCAATAAGTCATACAATTGGTAGATATGACTTATTT TATTTTTGTATTATTCACTATATCTTTATGATATTTAAGTATA AATAATTAAAAAAATTTATTGTACCTTATAGTCTGTCACCAAA AAAAAAAATTATCTGTAGGTAGTGAAATGCTAATGTTGATTT GTCTTTAAGGGCTTGTTAACTATCCTTTATTTTCTCATTTGTC TTAAATTAGGAGTTTGTGTTTAAATTACTCATCTAAGCAAAAA ATGTATATAAATCCCATTACTGGGTATATACCCAAAGGATTAT AAATCATGCTGCTATAAAGACACATGCACACGTATGTTTATTG CAGCACTATTCACAATAGCAAAGACTTGGAACCAACCCAAATG TCCATCAATGATAGACTTGATTAAGAAAATGTGCACATATACA CCATGGAATACTATGCAGCCATAAAAAAGGATGAGTTCATGTC CTTTGTAGGGACATGGATAAAGCTGGAAACCATCATTCTGAGC AAACTATTGCAAGGACAGAAAACCAAACACTGCATGTTCTCAC TCATAGGTGGGAATTGAACAATGAGAACACTTGGACACAAGGT GGGGAACACCACACACCAGGGCCTGTCATGGGTGGGGGGAGT GGGGAGGGATAGCATTAGGAGATATACCTAATGTAAATGATGA GTTAATGGGTGCAGCACACCAACATGGCACATGTATACATATG TAGCAAACCTGCACGTTGTGCACATGTACCCTAGAACTTAAAG TATAATTAAAAAAAAAAGAAAACAGAAGCTATTTATAAAGAA GTTATTTGCTGAAATAAATGTGATCTTTCCCATTAAAAAAATA AAGAAATTTTGGGGTAAAAAAACACAATATATTGTATTCTTGA AAAATTCTAAGAGAGTGGATGTGAAGTGTTCTCACCACAAAAG TGATAACTAATTGAGGTAATGCACATATTAATTAGAAAGATTT TGTCATTCCACAATGTATATATACTTAAAAATATGTTATACAC AATAAATACATACATTAAAAAATAAGTAAATGTA | |
| 3UTR-012 | Col6a1; collagen, type VI, alpha 1 | CCCACCCTGCACGCCGGCACCAAACCCTGTCCTCCCACCCCTC CCCACTCATCACTAAACAGAGTAAAATGTGATGCGAATTTTCC CGACCAACCTGATTCGCTAGATTTTTTTAAGGAAAAGCTTGG AAAGCCAGGACACAACGCTGCTGCCTGCTTTGTGCAGGGTCCT CCGGGGCTCAGCCCTGAGTTGGCATCACCTGCGCAGGGCCCTC TGGGGCTCAGCCCTGAGCTAGTGTCACCTGCACAGGGCCCTCT GAGGCTCAGCCCTGAGCTGGCGTCACCTGTGCAGGGCCCTCTG GGGCTCAGCCCTGAGCTGGCCTCACCTGGGTTCCCCACCCCGG GCTCTCCTGCCCTGCCCTCCTGCCCGCCCTCCCTCCTGCCTGC GCAGCTCCTTCCCTAGGCACCTCTGTGCTGCATCCCACCAGCC TGAGCAAGACGCCCTCTCGGGGCCTGTGCCGCACTAGCCTCCC TCTCCTCTGTCCCCATAGCTGGTTTTTCCCACCAATCCTCACC TAACGTTACTTTACAATTAAACTCAAAGCAAGCTCTTCTCCT CAGCTTGGGGCAGCCATTGGCCTCTGTCTCGTTTTGGGAAACC AAGGTCAGGAGGCCGTTGCAGACATAAATCTCGGCGACTCGGC CCCGTCTCCTGAGGGTCCTGCTGGTGACCGGCCTGGACCTTGG CCCTACAGCCCTGGAGGCCGCTGCTGACCAGCACTGACCCCGA | 243 |

TABLE 6-continued

3'-Untranslated Regions

| 3' UTR Identifier | Name/ Description | Sequence | SEQ ID NO. |
|---|---|---|---|
| | | CCTCAGAGAGTACTCGCAGGGGCGCTGGCTGCACTCAAGACCC TCGAGATTAACGGTGCTAACCCCGTCTGCTCCTCCCTCCCGCA GAGACTGGGGCCTGGACTGGACATGAGAGCCCCTTGGTGCCAC AGAGGGCTGTGTCTTACTAGAAACAACGCAAACCTCTCCTTCC TCAGAATAGTGATGTGTTCGACGTTTTATCAAAGGCCCCCTTT CTATGTTCATGTTAGTTTTGCTCCTTCTGTGTTTTTTCTGAA CCATATCCATGTTGCTGACTTTTCCAAATAAAGGTTTTCACTC CTCTC | |
| 3UTR-013 | Calr; calreticulin | AGAGGCCTGCCTCCAGGGCTGGACTGAGGCCTGAGCGCTCCTG CCGCAGAGCTGGCCGCGCCAAATAATGTCTCTGTGAGACTCGA GAACTTTCATTTTTTTCCAGGCTGGTTCGGATTTGGGGTGGAT TTTGGTTTTGTTCCCCTCCTCCACTCTCCCCCACCCCCTCCCC GCCCTTTTTTTTTTTTTTTTAAACTGGTATTTTATCTTTGA TTCTCCTTCAGCCCTCACCCCTGGTTCTCATCTTTCTTGATCA ACATCTTTTCTTGCCTCTGTCCCCTTCTCTCATCTCTTAGCTC CCCTCCAACCTGGGGGGCAGTGGTGTGGAGAAGCCACAGGCCT GAGATTTCATCTGCTCTCCTTCCTGGAGCCCAGAGGAGGGCAG CAGAAGGGGTGGTGTCTCCAACCCCCCAGCACTGAGGAAGAA CGGGGCTCTTCTCATTTCACCCCTCCCTTTCTCCCCTGCCCCC AGGACTGGGCCACTTCTGGGTGGGGCAGTGGGTCCCAGATTGG CTCACACTGAGAATGTAAGAACTACAAACAAAATTTCTATTAA ATTAAATTTTGTGTCTCC | 244 |
| 3UTR-014 | Col1a1; collagen, type I, alpha 1 | CTCCCTCCATCCCAACCTGGCTCCCTCCCACCCAACCAACTTT CCCCCCAACCCGGAAACAGACAAGCAACCCAAACTGAACCCCC TCAAAAGCCAAAAAATGGGAGACAATTTCACATGGACTTTGGA AAATATTTTTTCCTTTGCATTCATCTCTCAAACTTAGTTTTT ATCTTTGACCAACCGAACATGACCAAAAACCAAAAGTGCATTC AACCTTACCAAAAAAAAAAAAAAAAAAAAGAATAAATAAATAAC TTTTTAAAAAAGGAAGCTTGGTCCACTTGCTTGAAGACCCATG CGGGGGTAAGTCCCTTTCTGCCCGTTGGGCTTATGAAACCCCA ATGCTGCCCTTTCTGCTCCTTTCTCCACACCCCCCTTGGGGCC TCCCCTCCACTCCTTCCCAAATCTGTCTCCCCAGAAGACACAG GAAACAATGTATTGTCTGCCCAGCAATCAAAGGCAATGCTCAA ACACCCAAGTGGCCCCCACCCTCAGCCCGCTCCTGCCCGCCCA GCACCCCCAGGCCCTGGGGGACCTGGGGTTCTCAGACTGCCAA AGAAGCCTTGCCATCTGGCGCTCCCATGGCTCTTGCAACATCT CCCCCTTCGTTTTTGAGGGGGTCATGCCGGGGGAGCCACCAGCC CCTCACTGGGTTCGGAGGAGAGTCAGGAAGGGCCACGACAAAG CAGAAACATCGGATTTGGGGAACGCGTGTCAATCCCTTGTGCC GCAGGGCTGGGCGGGAGAGACTGTTCTGTTCCTTGTGTAACTG TGTTGCTGAAAGACTACCTCGTTCTTGTCTTGATGTGTCACCG GGGCAACTGCCTGGGGGCGGGGATGGGGGCAGGGTGGAAGCGG CTCCCCATTTTATACCAAAGGTGCTACATCTATGTGATGGGTG GGGTGGGGAGGGAATCACTGGTGCTATAGAAATTGAGATGCCC CCCCAGGCCAGCAAATGTTCCTTTTTGTTCAAAGTCTATTTTT ATTCCTTGATATTTTCTTTTTTTTTTTTTTTTGTGGATG GGGACTTGTGAATTTTTCTAAAGGTGCTATTTAACATGGGAGG AGAGCGTGTGCGGCTCCAGCCCAGCCCGCTGCTCACTTTCCAC CCTCTCTCCACCTGCCTCTGGCTTCTCAGGCCTCTGCTCTCCG ACCTCTCTCCTCTGAAACCCTCCTCCACAGCTGCAGCCCATCC TCCCGGCTCCCTCCTAGTCTGTCCTGCGTCCTCTGTCCCCGGG TTTCAGAGACAACTTCCCAAAGCACAAAGCAGTTTTTCCCCCT AGGGGTGGGAGGAAGCAAAAGACTCTGTACCTATTTTGTATGT GTATAATAATTTGAGATGTTTTAATTATTTTGATTGCTGGAA TAAAGCATGTGGAAATGACCCAAACATAATCCGCAGTGGCCTC CTAATTTCCTTCTTTGGAGTTGGGGGAGGGGTAGACATGGGA AGGGGCTTTGGGGTGATGGGCTTGCCTTCCATTCCTGCCCTTT CCCTCCCCACTATTCTCTTCTAGATCCCTCCATAACCCCACTC CCCTTTCTCTCACCCTTCTTATACCGCAAACTTTCTACTTCC TCTTTCATTTTCTATTCTTGCAATTTCCTTGCACCTTTTCCAA ATCCTCTTCTCCCCTGCAATACCATACAGGCAATCCACGTGCA CAACACACACACACACTCTTCACATCTGGGGTTGTCCAAACCT CATACCCACTCCCCTTCAAGCCCATCCACTCTCCACCCCCTGG ATGCCCTGCACTTGGTGGCGGTGGGATGCTCATGGATACTGGG AGGGTGAGGGGAGTGGAACCCGTGAGGAGGACCTGGGGGCCTC TCCTTGAACTGACATGAAGGGTCATCTGGCCTCTGCTCCCTTC TCACCCACGCTGACCTCCTGCCGAAGGAGCAACGCAACAGGAG AGGGGTCTGCTGAGCCTGGCGAGGGTCTGGGAGGGACCAGGAG GAAGGCGTGCTCCCTGCTCGCTGTCCTGGCCCTGGGGAGTGA GGGAGACAGACACCTGGGAGAGCTGTGGGGAAGGCACTCGCAC CGTGCTCTTGGGAAGGAAGGAGACCTGGCCCTGCTCACCACGG ACTGGGTGCCTCGACCTCCTGAATCCCCAGAACACAACCCCCC | 245 |

TABLE 6-continued

3'-Untranslated Regions

| 3' UTR Identifier | Name/ Description | Sequence | SEQ ID NO. |
|---|---|---|---|
| | | TGGGCTGGGGTGGTCTGGGGAACCATCGTGCCCCCGCCTCCCG CCTACTCCTTTTTAAGCTT | |
| 3UTR-015 | Plod1; procollagen-lysine, 2-oxoglutarate 5-dioxygenase 1 | TTGGCCAGGCCTGACCCTCTTGGACCTTTCTTCTTTGCCGACA ACCACTGCCCAGCAGCCTCTGGGACCTCGGGGTCCCAGGGAAC CCAGTCCAGCCTCCTGGCTGTTGACTTCCCATTGCTCTTGGAG CCACCAATCAAAGAGATTCAAAGAGATTCCTGCAGGCCAGAGG CGGAACACACCTTTATGGCTGGGGCTCTCCGTGGTGTTCTGGA CCCAGCCCCTGGAGACACCATTCACTTTTACTGCTTTGTAGTG ACTCGTGCTCTCCAACCTGTCTTCCTGAAAAACCAAGGCCCCC TTCCCCCACCTCTTCCATGGGGTGAGACTTGAGCAGAACAGGG GCTTCCCCAAGTTGCCCAGAAAGACTGTCTGGGTGAGAAGCCA TGGCCAGAGCTTCTCCCAGGCACAGGTGTTGCACCAGGGACTT CTGCTTCAAGTTTTGGGGTAAAGACACCTGGATCAGACTCCAA GGGCTGCCCTGAGTCTGGGACTTCTGCCTCCATGGCTGGTCAT GAGAGCAAACCGTAGTCCCCTGGAGACAGCGACTCCAGAGAAC CTCTTGGGAGACAGAAGAGGCATCTGTGCACAGCTCGATCTTC TACTTGCCTGTGGGAGGGGAGTGACAGGTCCACACACCACAC TGGGTCACCCTGTCCTGGATGCCTCTGAAGAGAGGGACAGACC GTCAGAAACTGGAGAGTTTCTATTAAAGGTCATTTAAACCA | 246 |
| 3UTR-016 | Nucb1; nucleobindin 1 | TCCTCCGGGACCCCAGCCCTCAGGATTCCTGATGCTCCAAGGC GACTGATGGGCGCTGGATGAAGTGGCACAGTCAGCTTCCCTGG GGGCTGGTGTCATGTTGGGCTCCTGGGGCGGGGGCACGGCCTG GCATTTCACGCATTGCTGCCACCCCAGGTCCACCTGTCTCCAC TTTCACAGCCTCCAAGTCTGTGGCTCTTCCCTTCTGTCCTCCG AGGGGCTTGCCTTCTCTCGTGTCCAGTGAGGTGCTCAGTGATC GGCTTAACTTAGAGAAGCCCGCCCCCTCCCCTTCTCCGTCTGT CCCAAGAGGGTCTGCTCTGAGCCTGCGTTCCTAGGTGGCTCGG CCTCAGCTGCCTGGGTTGTGGCCGCCCTAGCATCCTGTATGCC CACAGCTACTGGAATCCCCGCTGCTGCTCCGGGCCAAGCTTCT GGTTGATTAATGAGGGCATGGGGTGGTCCCTCAAGACCTTCCC CTACCTTTTGTGGAACCAGTGATGCCTCAAAGACAGTGTCCCC TCCACAGCTGGGTGCCAGGGGCAGGGGATCCTCAGTATAGCCG GTGAACCCTGATACCAGGAGCCTGGGCCTCCCTGAACCCCTGG CTTCCAGCCATCTCATCGCCAGCCTCCTCCTGGACCTCTTGGC CCCCAGCCCCTTCCCCACACAGCCCCAGAAGGGTCCCAGAGCT GACCCCACTCCAGGACCTAGGCCCAGCCCCTCAGCCTCATCTG GAGCCCCTGAAGACCAGTCCCACCCACCTTTCTGGCCTCATCT GACACTGCTCCGCATCCTGCTGTGTGTCCTGTTCCATGTTCCG GTTCCATCCAAATACACTTTCTGGAACAAA | 247 |
| 3UTR-017 | α-globin | GCTGGAGCCTCGGTGGCCATGCTTCTTGCCCCTTGGGCCTCCC CCCAGCCCCTCCTCCCCTTCCTGCACCCGTACCCCCGTGGTCT TTGAATAAAGTCTGAGTGGGCGGC | 248 |
| 3UTR-018 | | TGATAATAGGCTGGAGCCTCGGTGGCCATGCTTCTTGCCCCTT GGGCCTCCCCCCAGCCCCTCCTCCCCTTCCTGCACCCGTACCC CCGTGGTCTTTGAATAAAGTCTGAGTGGGCGGC | 267 |
| 3UTR-019 | | TGATAATAGTCCATAAAGTAGGAAACACTACAGCTGGAGCCTC GGTGGCCATGCTTCTTGCCCCTTGGGCCTCCCCCCAGCCCCTC CTCCCCTTCCTGCACCCGTACCCCCCGCATTATTACTCACGGT ACGAGTGGTCTTTGAATAAAGTCTGAGTGGGCGGC | 773 |
| 3UTR-020 | | TGATAATAGGCTGGAGCCTCGGTGGCCATGCTTCTTGCCCCTT GGGCCTCCCCCCAGCCCCTCCTCCCCTTCCTGCACCCGTACCC CCCGCATTATTACTCACGGTACGAGTGGTCTTTGAATAAAGTC TGAGTGGGCGGC | 774 |

In certain embodiments, the 3' UTR useful for the polynucleotides comprises SEQ ID NO: 267.

In certain embodiments, the 5'UTR and/or 3'UTR sequence of the disclosure comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of 5'UTR sequences comprising any of SEQ ID NOs: 215-231 and/or 3'UTR sequences comprises any of SEQ ID NOs: 232-248, and any combination thereof.

The polynucleotides of the disclosure can comprise combinations of features. For example, the ORF can be flanked by a 5'UTR that comprises a strong Kozak translational initiation signal and/or a 3'UTR comprising an oligo(dT) sequence for templated addition of a poly-A tail. A 5'UTR can comprise a first polynucleotide fragment and a second polynucleotide fragment from the same and/or different UTRs (see, e.g., US2010/0293625, herein incorporated by reference in its entirety).

It is also within the scope of the present disclosure to have patterned UTRs. As used herein "patterned UTRs" include a repeating or alternating pattern, such as ABABAB or AABBAABBAABB or ABCABCABC or variants thereof repeated once, twice, or more than 3 times. In these patterns, each letter, A, B, or C represent a different UTR nucleic acid sequence.

Other non-UTR sequences can be used as regions or subregions within the polynucleotides of the disclosure. For example, introns or portions of intron sequences can be incorporated into the polynucleotides of the disclosure. Incorporation of intronic sequences can increase protein production as well as polynucleotide expression levels. In some embodiments, the polynucleotide of the disclosure comprises an internal ribosome entry site (IRES) instead of or in addition to a UTR (see, e.g., Yakubov et al., Biochem. Biophys. Res. Commun. 2010 394(1):189-193, the contents of which are incorporated herein by reference in their entirety). In some embodiments, the polynucleotide of the disclosure comprises 5' and/or 3' sequence associated with the 5' and/or 3' ends of rubella virus (RV) genomic RNA, respectively, or deletion derivatives thereof, including the 5' proximal open reading frame of RV RNA encoding non-structural proteins (e.g., see Pogue et al., J. Virol. 67(12): 7106-7117, the contents of which are incorporated herein by reference in their entirety). Viral capsid sequences can also be used as a translational enhancer, e.g., the 5' portion of a capsid sequence, (e.g., semliki forest virus and sindbis virus capsid RNAs as described in Sjoberg et al., Biotechnology (NY) 1994 12(11):1127-1131, and Frolov and Schlesinger J. Virol. 1996 70(2):1182-1190, the contents of each of which are incorporated herein by reference in their entirety). In some embodiments, the polynucleotide comprises an IRES instead of a 5'UTR sequence. In some embodiments, the polynucleotide comprises an ORF and a viral capsid sequence. In some embodiments, the polynucleotide comprises a synthetic 5'UTR in combination with a non-synthetic 3'UTR.

In some embodiments, the UTR can also include at least one translation enhancer polynucleotide, translation enhancer element, or translational enhancer elements (collectively, "TEE," which refers to nucleic acid sequences that increase the amount of polypeptide or protein produced from a polynucleotide. As a non-limiting example, the TEE can include those described in US2009/0226470, incorporated herein by reference in its entirety, and others known in the art. As a non-limiting example, the TEE can be located between the transcription promoter and the start codon. In some embodiments, the 5'UTR comprises a TEE.

In one aspect, a TEE is a conserved element in a UTR that can promote translational activity of a nucleic acid such as, but not limited to, cap-dependent or cap-independent translation. The conservation of these sequences has been shown across 14 species including humans. See, e.g., Panek et al., "An evolutionary conserved pattern of 18S rRNA sequence complementarity to mRNA 5'UTRs and its implications for eukaryotic gene translation regulation," Nucleic Acids Research 2013, doi:10.1093/nar/gkt548, incorporated herein by reference in its entirety.

In one non-limiting example, the TEE comprises the TEE sequence in the 5'-leader of the Gtx homeodomain protein. See Chappell et al., PNAS 2004 101:9590-9594, incorporated herein by reference in its entirety.

In another non-limiting example, the TEE comprises a TEE having one or more of the sequences of SEQ ID NOs: 1-35 in US2009/0226470, US2013/0177581, and WO2009/075886; SEQ ID NOs: 1-5 and 7-645 in WO2012/009644; and SEQ ID NO: 1 WO1999/024595, U.S. Pat. Nos. 6,310, 197, and 6,849,405; the contents of each of which are incorporated herein by reference in their entirety.

In some embodiments, the TEE is an internal ribosome entry site (IRES), HCV-IRES, or an IRES element such as, but not limited to, those described in: U.S. Pat. No. 7,468, 275, US2007/0048776, US2011/0124100, WO2007/025008, and WO2001/055369; the contents of each of which re incorporated herein by reference in their entirety. The IRES elements can include, but are not limited to, the Gtx sequences (e.g., Gtx9-nt, Gtx8-nt, Gtx7-nt) as described by Chappell et al., PNAS 2004 101:9590-9594, Zhou et al., PNAS 2005 102:6273-6278, US2007/0048776, US2011/0124100, and WO2007/025008; the contents of each of which are incorporated herein by reference in their entirety.

"Translational enhancer polynucleotide" or "translation enhancer polynucleotide sequence" refer to a polynucleotide that includes one or more of the TEE provided herein and/or known in the art (see. e.g., U.S. Pat. Nos. 6,310,197, 6,849,405, 7,456,273, 7,183,395, US2009/0226470, US2007/0048776, US2011/0124100, US2009/0093049, US2013/0177581, WO2009/075886, WO2007/025008, WO2012/009644, WO2001/055371, WO1999/024595, EP2610341A1, and EP2610340A1; the contents of each of which are incorporated herein by reference in their entirety), or their variants, homologs, or functional derivatives. In some embodiments, the polynucleotide of the disclosure comprises one or multiple copies of a TEE. The TEE in a translational enhancer polynucleotide can be organized in one or more sequence segments. A sequence segment can harbor one or more of the TEEs provided herein, with each TEE being present in one or more copies. When multiple sequence segments are present in a translational enhancer polynucleotide, they can be homogenous or heterogeneous. Thus, the multiple sequence segments in a translational enhancer polynucleotide can harbor identical or different types of the TEE provided herein, identical or different number of copies of each of the TEE, and/or identical or different organization of the TEE within each sequence segment. In one embodiment, the polynucleotide of the disclosure comprises a translational enhancer polynucleotide sequence.

In some embodiments, a 5'UTR and/or 3'UTR of a polynucleotide of the disclosure comprises at least one TEE or portion thereof that is disclosed in: WO1999/024595, WO2012/009644, WO2009/075886, WO2007/025008, WO1999/024595, WO2001/055371, EP2610341A1, EP2610340A1, U.S. Pat. Nos. 6,310,197, 6,849,405, 7,456, 273, 7,183,395, US2009/0226470, US2011/0124100, US2007/0048776, US2009/0093049, or US2013/0177581, the contents of each are incorporated herein by reference in their entirety.

In some embodiments, a 5'UTR and/or 3'UTR of a polynucleotide of the disclosure comprises a TEE that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, at least 99%, or 100% identical to a TEE disclosed in: US2009/0226470, US2007/0048776, US2013/0177581, US2011/0124100, WO1999/024595, WO2012/009644, WO2009/075886, WO2007/025008, EP2610341A1, EP2610340A1, U.S. Pat. No. 6,310,197, 6,849,405, 7,456,273, 7,183,395, Chappell et al., PNAS 2004 101:9590-9594, Zhou et al., PNAS 2005 102:6273-6278, and Supplemental Table 1 and in Supplemental Table 2 of Wellensiek et al., "Genome-wide profiling of human cap-independent translation-enhancing elements," Nature Methods 2013, DOI:10.1038/ NMETH.2522; the contents of each of which are incorporated herein by reference in their entirety.

In some embodiments, a 5'UTR and/or 3'UTR of a polynucleotide of the disclosure comprises a TEE which is selected from a 5-30 nucleotide fragment, a 5-25 nucleotide fragment, a 5-20 nucleotide fragment, a 5-15 nucleotide fragment, or a 5-10 nucleotide fragment (including a fragment of 5, 6, 7, 8, 9, 10, 11, 12, 13, 14, 15, 16, 17, 18, 19, 20, 21, 22, 23, 24, 25, 26, 27, 28, 29, or 30 nucleotides) of a TEE sequence disclosed in: US2009/0226470, US2007/ 0048776, US2013/0177581, US2011/0124100, WO1999/ 024595, WO2012/009644, WO2009/075886, WO2007/ 025008, EP2610341A1, EP2610340A1, U.S. Pat. No. 6,310,197, 6,849,405, 7,456,273, 7,183,395, Chappell et al., PNAS 2004 101:9590-9594, Zhou et al., PNAS 2005 102: 6273-6278, and Supplemental Table 1 and in Supplemental Table 2 of Wellensiek et al., "Genome-wide profiling of human cap-independent translation-enhancing elements," Nature Methods 2013, DOI:10.1038/NMETH.2522.

In some embodiments, a 5'UTR and/or 3'UTR of a polynucleotide of the disclosure comprises a TEE which is a transcription regulatory element described in any of U.S. Pat. No. 7,456,273, 7,183,395, US2009/0093049, and WO2001/055371, the contents of each of which are incorporated herein by reference in their entirety. The transcription regulatory elements can be identified by methods known in the art, such as, but not limited to, the methods described in U.S. Pat. Nos. 7,456,273, 7,183,395, US2009/ 0093049, and WO2001/055371.

In some embodiments, a 5'UTR and/or 3'UTR comprising at least one TEE described herein can be incorporated in a monocistronic sequence such as, but not limited to, a vector system or a nucleic acid vector. As non-limiting examples, the vector systems and nucleic acid vectors can include those described in U.S. Pat. Nos. 7,456,273, 7,183,395, US2007/0048776, US2009/0093049, US2011/0124100, WO2007/025008, and WO2001/055371.

In some embodiments, a 5'UTR and/or 3'UTR of a polynucleotide of the disclosure comprises a TEE or portion thereof described herein. In some embodiments, the TEEs in the 3'UTR can be the same and/or different from the TEE located in the 5'UTR.

In some embodiments, a 5'UTR and/or 3'UTR of a polynucleotide of the disclosure can include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18 at least 19, at least 20, at least 21, at least 22, at least 23, at least 24, at least 25, at least 30, at least 35, at least 40, at least 45, at least 50, at least 55 or more than 60 TEE sequences. In one embodiment, the 5'UTR of a polynucleotide of the disclosure can include 1-60, 1-55, 1-50, 1-45, 1-40, 1-35, 1-30, 1-25, 1-20, 1-15, 1-10, 9, 8, 7, 6, 5, 4, 3, 2, or 1 TEE sequences. The TEE sequences in the 5'UTR of the polynucleotide of the disclosure can be the same or different TEE sequences. A combination of different TEE sequences in the 5'UTR of the polynucleotide of the disclosure can include combinations in which more than one copy of any of the different TEE sequences are incorporated. The TEE sequences can be in a pattern such as ABABAB or AAB-BAABBAABB or ABCABCABC or variants thereof repeated one, two, three, or more than three times. In these patterns, each letter, A, B, or C represent a different TEE nucleotide sequence.

In some embodiments, the TEE can be identified by the methods described in US2007/0048776, US2011/0124100, WO2007/025008, WO2012/009644, the contents of each of which are incorporated herein by reference in their entirety.

In some embodiments, the 5'UTR and/or 3'UTR comprises a spacer to separate two TEE sequences. As a non-limiting example, the spacer can be a 15 nucleotide spacer and/or other spacers known in the art. As another non-limiting example, the 5'UTR and/or 3'UTR comprises a TEE sequence-spacer module repeated at least once, at least twice, at least 3 times, at least 4 times, at least 5 times, at least 6 times, at least 7 times, at least 8 times, at least 9 times, at least 10 times, or more than 10 times in the 5'UTR and/or 3'UTR, respectively. In some embodiments, the 5'UTR and/or 3'UTR comprises a TEE sequence-spacer module repeated 1, 2, 3, 4, 5, 6, 7, 8, 9, or 10 times.

In some embodiments, the spacer separating two TEE sequences can include other sequences known in the art that can regulate the translation of the polynucleotide of the disclosure, e.g., miR sequences described herein (e.g., miR binding sites and miR seeds). As a non-limiting example, each spacer used to separate two TEE sequences can include a different miR sequence or component of a miR sequence (e.g., miR seed sequence).

In some embodiments, a polynucleotide of the disclosure comprises a miR and/or TEE sequence. In some embodiments, the incorporation of a miR sequence and/or a TEE sequence into a polynucleotide of the disclosure can change the shape of the stem loop region, which can increase and/or decrease translation. See e.g., Kedde et al., Nature Cell Biology 2010 12(10):1014-20, herein incorporated by reference in its entirety).

Sensor Sequences and MicroRNA (miRNA) Binding Sites

Polynucleotides of the disclosure can include regulatory elements, for example, microRNA (miRNA) binding sites, transcription factor binding sites, structured mRNA sequences and/or motifs, artificial binding sites engineered to act as pseudo-receptors for endogenous nucleic acid binding molecules, and combinations thereof. In some embodiments, polynucleotides including such regulatory elements are referred to as including "sensor sequences". Non-limiting examples of sensor sequences are described in U.S. Publication 2014/0200261, the contents of which are incorporated herein by reference in their entirety.

In some embodiments, a polynucleotide (e.g., a ribonucleic acid (RNA), e.g., a messenger RNA (mRNA)) of the disclosure comprises an open reading frame (ORF) encoding a polypeptide of interest and further comprises one or more miRNA binding site(s). Inclusion or incorporation of miRNA binding site(s) provides for regulation of polynucleotides of the disclosure, and in turn, of the polypeptides encoded therefrom, based on tissue-specific and/or cell-type specific expression of naturally-occurring miRNAs.

A miRNA, e.g., a natural-occurring miRNA, is a 19-25 nucleotide long noncoding RNA that binds to a polynucleotide and down-regulates gene expression either by reducing stability or by inhibiting translation of the polynucleotide. A miRNA sequence comprises a "seed" region, i.e., a sequence in the region of positions 2-8 of the mature miRNA. A miRNA seed can comprise positions 2-8 or 2-7 of the mature miRNA. In some embodiments, a miRNA seed can comprise 7 nucleotides (e.g., nucleotides 2-8 of the mature miRNA), wherein the seed-complementary site in the corresponding miRNA binding site is flanked by an adenosine (A) opposed to miRNA position 1. In some embodiments, a miRNA seed can comprise 6 nucleotides (e.g., nucleotides 2-7 of the mature miRNA), wherein the seed-complementary site in the corresponding miRNA binding site is flanked by an adenosine (A) opposed to miRNA position 1. See, for example, Grimson A, Farh K K, Johnston W K, Garrett-Engele P, Lim L P, Bartel D P; Mol Cell. 2007 Jul. 6; 27(1):91-105. miRNA profiling of the target cells or tissues can be conducted to determine the presence or absence of miRNA in the cells or tissues. In some embodiments, a polynucleotide (e.g., a ribonucleic acid (RNA), e.g., a messenger RNA (mRNA)) of the disclosure comprises one or more microRNA binding sites, microRNA target sequences, microRNA complementary sequences, or microRNA seed complementary sequences. Such sequences can correspond to, e.g., have complementarity to, any known microRNA such as those taught in US Publication US2005/0261218 and US Publication US2005/0059005, the contents of each of which are incorporated herein by reference in their entirety.

As used herein, the term "microRNA (miRNA or miR) binding site" refers to a sequence within a polynucleotide, e.g., within a DNA or within an RNA transcript, including in the 5'UTR and/or 3'UTR, that has sufficient complementarity to all or a region of a miRNA to interact with, associate with or bind to the miRNA. In some embodiments, a polynucleotide of the disclosure comprising an ORF encoding a polypeptide of interest and further comprises one or more miRNA binding site(s). In exemplary embodiments, a 5'UTR and/or 3'UTR of the polynucleotide (e.g., a ribonucleic acid (RNA), e.g., a messenger RNA (mRNA)) comprises the one or more miRNA binding site(s).

A miRNA binding site having sufficient complementarity to a miRNA refers to a degree of complementarity sufficient to facilitate miRNA-mediated regulation of a polynucleotide, e.g., miRNA-mediated translational repression or degradation of the polynucleotide. In exemplary aspects of the disclosure, a miRNA binding site having sufficient complementarity to the miRNA refers to a degree of complementarity sufficient to facilitate miRNA-mediated degradation of the polynucleotide, e.g., miRNA-guided RNA-induced silencing complex (RISC)-mediated cleavage of mRNA. The miRNA binding site can have complementarity to, for example, a 19-25 nucleotide miRNA sequence, to a 19-23 nucleotide miRNA sequence, or to a 22 nucleotide miRNA sequence. A miRNA binding site can be complementary to only a portion of a miRNA, e.g., to a portion less than 1, 2, 3, or 4 nucleotides of the full length of a naturally-occurring miRNA sequence. Full or complete complementarity (e.g., full complementarity or complete complementarity over all or a significant portion of the length of a naturally-occurring miRNA) is preferred when the desired regulation is mRNA degradation.

In some embodiments, a miRNA binding site includes a sequence that has complementarity (e.g., partial or complete complementarity) with an miRNA seed sequence. In some embodiments, the miRNA binding site includes a sequence that has complete complementarity with a miRNA seed sequence. In some embodiments, a miRNA binding site includes a sequence that has complementarity (e.g., partial or complete complementarity) with an miRNA sequence. In some embodiments, the miRNA binding site includes a sequence that has complete complementarity with a miRNA sequence. In some embodiments, a miRNA binding site has complete complementarity with a miRNA sequence but for 1, 2, or 3 nucleotide substitutions, terminal additions, and/or truncations.

In some embodiments, the miRNA binding site is the same length as the corresponding miRNA. In other embodiments, the miRNA binding site is one, two, three, four, five, six, seven, eight, nine, ten, eleven or twelve nucleotide(s) shorter than the corresponding miRNA at the 5' terminus, the 3' terminus, or both. In still other embodiments, the micro-RNA binding site is two nucleotides shorter than the corresponding microRNA at the 5' terminus, the 3' terminus, or both. The miRNA binding sites that are shorter than the corresponding miRNAs are still capable of degrading the mRNA incorporating one or more of the miRNA binding sites or preventing the mRNA from translation.

In some embodiments, the miRNA binding site binds the corresponding mature miRNA that is part of an active RISC containing Dicer. In another embodiment, binding of the miRNA binding site to the corresponding miRNA in RISC degrades the mRNA containing the miRNA binding site or prevents the mRNA from being translated. In some embodiments, the miRNA binding site has sufficient complementarity to miRNA so that a RISC complex comprising the miRNA cleaves the polynucleotide comprising the miRNA binding site. In other embodiments, the miRNA binding site has imperfect complementarity so that a RISC complex comprising the miRNA induces instability in the polynucleotide comprising the miRNA binding site. In another embodiment, the miRNA binding site has imperfect complementarity so that a RISC complex comprising the miRNA represses transcription of the polynucleotide comprising the miRNA binding site.

In some embodiments, the miRNA binding site has one, two, three, four, five, six, seven, eight, nine, ten, eleven or twelve mismatch(es) from the corresponding miRNA.

In some embodiments, the miRNA binding site has at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one contiguous nucleotides complementary to at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one, respectively, contiguous nucleotides of the corresponding miRNA.

By engineering one or more miRNA binding sites into a polynucleotide of the disclosure, the polynucleotide can be targeted for degradation or reduced translation, provided the miRNA in question is available. This can reduce off-target effects upon delivery of the polynucleotide. For example, if a polynucleotide of the disclosure is not intended to be delivered to a tissue or cell but ends up is said tissue or cell, then a miRNA abundant in the tissue or cell can inhibit the expression of the gene of interest if one or multiple binding sites of the miRNA are engineered into the 5'UTR and/or 3'UTR of the polynucleotide.

Conversely, miRNA binding sites can be removed from polynucleotide sequences in which they naturally occur in order to increase protein expression in specific tissues. For example, a binding site for a specific miRNA can be removed from a polynucleotide to improve protein expression in tissues or cells containing the miRNA.

In one embodiment, a polynucleotide of the disclosure can include at least one miRNA-binding site in the 5'UTR and/or 3'UTR in order to regulate cytotoxic or cytoprotective mRNA therapeutics to specific cells such as, but not limited to, normal and/or cancerous cells. In another embodiment, a polynucleotide of the disclosure can include two, three, four, five, six, seven, eight, nine, ten, or more miRNA-binding sites in the 5'-UTR and/or 3'-UTR in order to regulate cytotoxic or cytoprotective mRNA therapeutics to specific cells such as, but not limited to, normal and/or cancerous cells.

Regulation of expression in multiple tissues can be accomplished through introduction or removal of one or more miRNA binding sites, e.g., one or more distinct miRNA binding sites. The decision whether to remove or insert a miRNA binding site can be made based on miRNA expression patterns and/or their profilings in tissues and/or cells in development and/or disease. Identification of miR-NAs, miRNA binding sites, and their expression patterns and role in biology have been reported (e.g., Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; Gentner and Naldini, Tissue Antigens. 2012 80:393-403 and all references therein; each of which is incorporated herein by reference in its entirety).

miRNAs and miRNA binding sites can correspond to any known sequence, including non-limiting examples described in U.S. Publication Nos. 2014/0200261, 2005/0261218, and 2005/0059005, each of which are incorporated herein by reference in their entirety.

Examples of tissues where miRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126).

Specifically, miRNAs are known to be differentially expressed in immune cells (also called hematopoietic cells), such as antigen presenting cells (APCs) (e.g., dendritic cells and macrophages), macrophages, monocytes, B lymphocytes, T lymphocytes, granulocytes, natural killer cells, etc. Immune cell specific miRNAs are involved in immunogenicity, autoimmunity, the immune-response to infection, inflammation, as well as unwanted immune response after gene therapy and tissue/organ transplantation. Immune cells specific miRNAs also regulate many aspects of development, proliferation, differentiation and apoptosis of hematopoietic cells (immune cells). For example, miR-142 and miR-146 are exclusively expressed in immune cells, particularly abundant in myeloid dendritic cells. It has been demonstrated that the immune response to a polynucleotide can be shut-off by adding miR-142 binding sites to the 3'-UTR of the polynucleotide, enabling more stable gene transfer in tissues and cells. miR-142 efficiently degrades exogenous polynucleotides in antigen presenting cells and suppresses cytotoxic elimination of transduced cells (e.g., Annoni A et al., blood, 2009, 114, 5152-5161; Brown B D, et al., Nat med. 2006, 12(5), 585-591; Brown B D, et al., blood, 2007, 110(13): 4144-4152, each of which is incorporated herein by reference in its entirety).

An antigen-mediated immune response can refer to an immune response triggered by foreign antigens, which, when entering an organism, are processed by the antigen presenting cells and displayed on the surface of the antigen presenting cells. T cells can recognize the presented antigen and induce a cytotoxic elimination of cells that express the antigen.

Introducing a miR-142 binding site into the 5'UTR and/or 3'UTR of a polynucleotide of the disclosure can selectively repress gene expression in antigen presenting cells through miR-142 mediated degradation, limiting antigen presentation in antigen presenting cells (e.g., dendritic cells) and thereby preventing antigen-mediated immune response after the delivery of the polynucleotide. The polynucleotide is then stably expressed in target tissues or cells without triggering cytotoxic elimination.

In one embodiment, binding sites for miRNAs that are known to be expressed in immune cells, in particular, antigen presenting cells, can be engineered into a polynucleotide of the disclosure to suppress the expression of the polynucleotide in antigen presenting cells through miRNA mediated RNA degradation, subduing the antigen-mediated immune response. Expression of the polynucleotide is maintained in non-immune cells where the immune cell specific miRNAs are not expressed. For example, in some embodiments, to prevent an immunogenic reaction against a liver specific protein, any miR-122 binding site can be removed and a miR-142 (and/or mirR-146) binding site can be engineered into the 5'UTR and/or 3'UTR of a polynucleotide of the disclosure.

To further drive the selective degradation and suppression in APCs and macrophage, a polynucleotide of the disclosure can include a further negative regulatory element in the 5'UTR and/or 3'UTR, either alone or in combination with miR-142 and/or miR-146 binding sites. As a non-limiting example, the further negative regulatory element is a Constitutive Decay Element (CDE).

Immune cell specific miRNAs include, but are not limited to, hsa-let-7a-2-3p, hsa-let-7a-3p, hsa-7a-5p, hsa-let-7c, hsa-let-7e-3p, hsa-let-7e-5p, hsa-let-7g-3p, hsa-let-7g-5p, hsa-let-7i-3p, hsa-let-7i-5p, miR-10a-3p, miR-10a-5p, miR-1184, hsa-let-7f-1-3p, hsa-let-7f-2-5p, hsa-let-7f-5p, miR-125b-1-3p, miR-125b-2-3p, miR-125b-5p, miR-1279, miR-130a-3p, miR-130a-5p, miR-132-3p, miR-132-5p, miR-142-3p, miR-142-5p, miR-143-3p, miR-143-5p, miR-146a-3p, miR-146a-5p, miR-146b-3p, miR-146b-5p, miR-147a, miR-147b, miR-148a-5p, miR-148a-3p, miR-150-3p, miR-150-5p, miR-151b, miR-155-3p, miR-155-5p, miR-15a-3p, miR-15a-5p, miR-15b-5p, miR-15b-3p, miR-16-1-3p, miR-16-2-3p, miR-16-5p, miR-17-5p, miR-181a-3p, miR-181a-5p, miR-181a-2-3p, miR-182-3p, miR-182-5p, miR-197-3p, miR-197-5p, miR-21-5p, miR-21-3p, miR-214-3p, miR-214-5p, miR-223-3p, miR-223-5p, miR-221-3p, miR-221-5p, miR-23b-3p, miR-23b-5p, miR-24-1-5p, miR-24-2-5p, miR-24-3p, miR-26a-1-3p, miR-26a-2-3p, miR-26a-5p, miR-26b-3p, miR-26b-5p, miR-27a-3p, miR-27a-5p, miR-27b-3p, miR-27b-5p, miR-28-3p, miR-28-5p, miR-2909, miR-29a-3p, miR-29a-5p, miR-29b-1-5p, miR-29b-2-5p, miR-29c-3p, miR-29c-5p, miR-30e-3p, miR-30e-5p, miR-331-5p, miR-339-3p, miR-339-5p, miR-345-3p, miR-345-5p, miR-346, miR-34a-3p, miR-34a-5p, miR-363-3p, miR-363-5p, miR-372, miR-377-3p, miR-377-5p, miR-493-3p, miR-493-5p, miR-542, miR-548b-5p, miR548c-5p, miR-548i, miR-548j, miR-548n, miR-574-3p, miR-598, miR-718, miR-935, miR-99a-3p, miR-99a-5p, miR-99b-3p, and miR-99b-5p. Furthermore, novel miRNAs can be identified in immune cell through micro-array hybridization and microtome analysis (e.g., Jima D D et al, Blood, 2010, 116:e118-e127; Vaz C et al., BMC Genomics, 2010, 11,288, the content of each of which is incorporated herein by reference in its entirety.)

miRNAs that are known to be expressed in the liver include, but are not limited to, miR-107, miR-122-3p, miR-122-5p, miR-1228-3p, miR-1228-5p, miR-1249, miR-129-5p, miR-1303, miR-151a-3p, miR-151a-5p, miR-152, miR-194-3p, miR-194-5p, miR-199a-3p, miR-199a-5p, miR-199b-3p, miR-199b-5p, miR-296-5p, miR-557, miR-581, miR-939-3p, and miR-939-5p. MiRNA binding sites from any liver specific miRNA can be introduced to or removed from a polynucleotide of the disclosure to regulate expression of the polynucleotide in the liver. Liver specific miRNA binding sites can be engineered alone or further in combination with immune cell (e.g., APC) miRNA binding sites in a polynucleotide of the disclosure.

miRNAs that are known to be expressed in the lung include, but are not limited to, let-7a-2-3p, let-7a-3p, let-7a-5p, miR-126-3p, miR-126-5p, miR-127-3p, miR-127-5p, miR-130a-3p, miR-130a-5p, miR-130b-3p, miR-130b-5p, miR-133a, miR-133b, miR-134, miR-18a-3p, miR-18a-5p, miR-18b-3p, miR-18b-5p, miR-24-1-5p, miR-24-2-5p, miR-24-3p, miR-296-3p, miR-296-5p, miR-32-3p, miR-337-3p, miR-337-5p, miR-381-3p, and miR-381-5p. miRNA binding sites from any lung specific miRNA can be introduced to or removed from a polynucleotide of the disclosure to regulate expression of the polynucleotide in the lung. Lung specific miRNA binding sites can be engineered alone or further in combination with immune cell (e.g., APC) miRNA binding sites in a polynucleotide of the disclosure.

miRNAs that are known to be expressed in the heart include, but are not limited to, miR-1, miR-133a, miR-133b, miR-149-3p, miR-149-5p, miR-186-3p, miR-186-5p, miR-208a, miR-208b, miR-210, miR-296-3p, miR-320, miR-451a, miR-451b, miR-499a-3p, miR-499a-5p, miR-499b-3p, miR-499b-5p, miR-744-3p, miR-744-5p, miR-92b-3p, and miR-92b-5p. mMiRNA binding sites from any heart specific microRNA can be introduced to or removed from a polynucleotide of the disclosure to regulate expression of the polynucleotide in the heart. Heart specific miRNA binding sites can be engineered alone or further in combination with immune cell (e.g., APC) miRNA binding sites in a polynucleotide of the disclosure.

miRNAs that are known to be expressed in the nervous system include, but are not limited to, miR-124-5p, miR-125a-3p, miR-125a-5p, miR-125b-1-3p, miR-125b-2-3p, miR-125b-5p, miR-1271-3p, miR-1271-5p, miR-128, miR-132-5p, miR-135a-3p, miR-135a-5p, miR-135b-3p, miR-135b-5p, miR-137, miR-139-5p, miR-139-3p, miR-149-3p, miR-149-5p, miR-153, miR-181c-3p, miR-181c-5p, miR-183-3p, miR-183-5p, miR-190a, miR-190b, miR-212-3p, miR-212-5p, miR-219-1-3p, miR-219-2-3p, miR-23a-3p, miR-23a-5p, miR-30a-5p, miR-30b-3p, miR-30b-5p, miR-30c-1-3p, miR-30c-2-3p, miR-30c-5p, miR-30d-3p, miR-30d-5p, miR-329, miR-342-3p, miR-3665, miR-3666, miR-380-3p, miR-380-5p, miR-383, miR-410, miR-425-3p, miR-425-5p, miR-454-3p, miR-454-5p, miR-483, miR-510, miR-516a-3p, miR-548b-5p, miR-548c-5p, miR-571, miR-7-1-3p, miR-7-2-3p, miR-7-5p, miR-802, miR-922, miR-9-3p, and miR-9-5p. miRNAs enriched in the nervous system further include those specifically expressed in neurons, including, but not limited to, miR-132-3p, miR-132-3p, miR-148b-3p, miR-148b-5p, miR-151a-3p, miR-151a-5p, miR-212-3p, miR-212-5p, miR-320b, miR-320e, miR-323a-3p, miR-323a-5p, miR-324-5p, miR-325, miR-326, miR-328, miR-922 and those specifically expressed in glial cells, including, but not limited to, miR-1250, miR-219-1-3p, miR-219-2-3p, miR-219-5p, miR-23a-3p, miR-23a-5p, miR-3065-3p, miR-3065-5p, miR-30e-3p, miR-30e-5p, miR-32-5p, miR-338-5p, and miR-657. miRNA binding sites from any CNS specific miRNA can be introduced to or removed from a polynucleotide of the disclosure to regulate expression of the polynucleotide in the nervous system. Nervous system specific miRNA binding sites can be engineered alone or further in combination with immune cell (e.g., APC) miRNA binding sites in a polynucleotide of the disclosure.

miRNAs that are known to be expressed in the pancreas include, but are not limited to, miR-105-3p, miR-105-5p, miR-184, miR-195-3p, miR-195-5p, miR-196a-3p, miR-196a-5p, miR-214-3p, miR-214-5p, miR-216a-3p, miR-216a-5p, miR-30a-3p, miR-33a-3p, miR-33a-5p, miR-375, miR-7-1-3p, miR-7-2-3p, miR-493-3p, miR-493-5p, and miR-944. MiRNA binding sites from any pancreas specific miRNA can be introduced to or removed from a polynucleotide of the disclosure to regulate expression of the polynucleotide in the pancreas. Pancreas specific miRNA binding sites can be engineered alone or further in combination with immune cell (e.g. APC) miRNA binding sites in a polynucleotide of the disclosure.

miRNAs that are known to be expressed in the kidney include, but are not limited to, miR-122-3p, miR-145-5p, miR-17-5p, miR-192-3p, miR-192-5p, miR-194-3p, miR-194-5p, miR-20a-3p, miR-20a-5p, miR-204-3p, miR-204-5p, miR-210, miR-216a-3p, miR-216a-5p, miR-296-3p, miR-30a-3p, miR-30a-5p, miR-30b-3p, miR-30b-5p, miR-30c-1-3p, miR-30c-2-3p, miR30c-5p, miR-324-3p, miR-335-3p, miR-335-5p, miR-363-3p, miR-363-5p, and miR-562. miRNA binding sites from any kidney specific miRNA can be introduced to or removed from a polynucleotide of the disclosure to regulate expression of the polynucleotide in the kidney. Kidney specific miRNA binding sites can be engineered alone or further in combination with immune cell (e.g., APC) miRNA binding sites in a polynucleotide of the disclosure.

miRNAs that are known to be expressed in the muscle include, but are not limited to, let-7g-3p, let-7g-5p, miR-1, miR-1286, miR-133a, miR-133b, miR-140-3p, miR-143-3p, miR-143-5p, miR-145-3p, miR-145-5p, miR-188-3p, miR-188-5p, miR-206, miR-208a, miR-208b, miR-25-3p, and miR-25-5p. MiRNA binding sites from any muscle specific miRNA can be introduced to or removed from a polynucleotide of the disclosure to regulate expression of the polynucleotide in the muscle. Muscle specific miRNA binding sites can be engineered alone or further in combination with immune cell (e.g., APC) miRNA binding sites in a polynucleotide of the disclosure.

miRNAs are also differentially expressed in different types of cells, such as, but not limited to, endothelial cells, epithelial cells, and adipocytes.

miRNAs that are known to be expressed in endothelial cells include, but are not limited to, let-7b-3p, let-7b-5p, miR-100-3p, miR-100-5p, miR-101-3p, miR-101-5p, miR-126-3p, miR-126-5p, miR-1236-3p, miR-1236-5p, miR-130a-3p, miR-130a-5p, miR-17-5p, miR-17-3p, miR-18a-3p, miR-18a-5p, miR-19a-3p, miR-19a-5p, miR-19b-1-5p, miR-19b-2-5p, miR-19b-3p, miR-20a-3p, miR-20a-5p, miR-217, miR-210, miR-21-3p, miR-21-5p, miR-221-3p, miR-221-5p, miR-222-3p, miR-222-5p, miR-23a-3p, miR-23a-5p, miR-296-5p, miR-361-3p, miR-361-5p, miR-421, miR-424-3p, miR-424-5p, miR-513a-5p, miR-92a-1-5p, miR-92a-2-5p, miR-92a-3p, miR-92b-3p, and miR-92b-5p. Many novel miRNAs are discovered in endothelial cells from deep-sequencing analysis (e.g., Voellenkle C et al., RNA, 2012, 18, 472-484, herein incorporated by reference in its entirety). miRNA binding sites from any endothelial cell specific miRNA can be introduced to or removed from a polynucleotide of the disclosure to regulate expression of the polynucleotide in the endothelial cells.

miRNAs that are known to be expressed in epithelial cells include, but are not limited to, let-7b-3p, let-7b-5p, miR-1246, miR-200a-3p, miR-200a-5p, miR-200b-3p, miR-200b-5p, miR-200c-3p, miR-200c-5p, miR-338-3p, miR-429, miR-451a, miR-451b, miR-494, miR-802 and miR-34a, miR-34b-5p, miR-34c-5p, miR-449a, miR-449b-3p, miR-449b-5p specific in respiratory ciliated epithelial cells, let-7 family, miR-133a, miR-133b, miR-126 specific in lung epithelial cells, miR-382-3p, miR-382-5p specific in renal epithelial cells, and miR-762 specific in corneal epithelial cells. miRNA binding sites from any epithelial cell specific miRNA can be introduced to or removed from a polynucleotide of the disclosure to regulate expression of the polynucleotide in the epithelial cells.

In addition, a large group of miRNAs are enriched in embryonic stem cells, controlling stem cell self-renewal as well as the development and/or differentiation of various cell lineages, such as neural cells, cardiac, hematopoietic cells, skin cells, osteogenic cells and muscle cells (e.g., Kuppusamy K T et al., Curr. Mol Med, 2013, 13(5), 757-764; Vidigal J A and Ventura A, Semin Cancer Biol. 2012, 22(5-6), 428-436; Goff L A et al., PLoS One, 2009, 4:e7192; Morin R D et al., Genome Res, 2008, 18, 610-621; Yoo J K et al., Stem Cells Dev. 2012, 21(11), 2049-2057, each of which is herein incorporated by reference in its entirety). MiRNAs abundant in embryonic stem cells include, but are not limited to, let-7a-2-3p, let-a-3p, let-7a-5p, let7d-3p, let-7d-5p, miR-103a-2-3p, miR-103a-5p, miR-106b-3p, miR-106b-5p, miR-1246, miR-1275, miR-138-1-3p, miR-138-2-3p, miR-138-5p, miR-154-3p, miR-154-5p, miR-200c-3p, miR-200c-5p, miR-290, miR-301a-3p, miR-301a-5p, miR-302a-3p, miR-302a-5p, miR-302b-3p, miR-302b-5p, miR-302c-3p, miR-302c-5p, miR-302d-3p, miR-302d-5p, miR-302e, miR-367-3p, miR-367-5p, miR-369-3p, miR-369-5p, miR-370, miR-371, miR-373, miR-380-5p, miR-423-3p, miR-423-5p, miR-486-5p, miR-520c-3p, miR-548e, miR-548f, miR-548g-3p, miR-548g-5p, miR-548i, miR-548k, miR-5481, miR-548m, miR-548n, miR-548o-3p, miR-548o-5p, miR-548p, miR-664a-3p, miR-664a-5p, miR-664b-3p, miR-664b-5p, miR-766-3p, miR-766-5p, miR-885-3p, miR-885-5p, miR-93-3p, miR-93-5p, miR-941, miR-96-3p, miR-96-5p, miR-99b-3p and miR-99b-5p. Many predicted novel miRNAs are discovered by deep sequencing in human embryonic stem cells (e.g., Morin R D et al., Genome Res, 2008, 18, 610-621; Goff L A et al., PLoS One, 2009, 4:e7192; Bar M et al., Stem cells, 2008, 26, 2496-2505, the content of each of which is incorporated herein by reference in its entirety).

In one embodiment, the binding sites of embryonic stem cell specific miRNAs can be included in or removed from the 3'UTR of a polynucleotide of the disclosure to modulate the development and/or differentiation of embryonic stem cells, to inhibit the senescence of stem cells in a degenerative condition (e.g. degenerative diseases), or to stimulate the senescence and apoptosis of stem cells in a disease condition (e.g. cancer stem cells).

Many miRNA expression studies are conducted to profile the differential expression of miRNAs in various cancer cells/tissues and other diseases. Some miRNAs are abnormally over-expressed in certain cancer cells and others are under-expressed. For example, miRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T cell lymphoma (WO2013/011378); colorectal cancer cells (WO2011/0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563, the content of each of which is incorporated herein by reference in its entirety.)

As a non-limiting example, miRNA binding sites for miRNAs that are over-expressed in certain cancer and/or tumor cells can be removed from the 3'UTR of a polynucleotide of the disclosure, restoring the expression suppressed by the over-expressed miRNAs in cancer cells, thus ameliorating the corresponsive biological function, for instance, transcription stimulation and/or repression, cell cycle arrest, apoptosis and cell death. Normal cells and tissues, wherein miRNAs expression is not up-regulated, will remain unaffected.

miRNA can also regulate complex biological processes such as angiogenesis (e.g., miR-132) (Anand and Cheresh Curr Opin Hematol 2011 18:171-176). In the polynucleotides of the disclosure, miRNA binding sites that are involved in such processes can be removed or introduced, in order to tailor the expression of the polynucleotides to biologically relevant cell types or relevant biological processes. In this context, the polynucleotides of the disclosure are defined as auxotrophic polynucleotides.

In some embodiments, a polynucleotide of the disclosure comprises a miRNA binding site, wherein the miRNA binding site comprises one or more nucleotide sequences selected from Table 7, including one or more copies of any one or more of the miRNA binding site sequences. In some embodiments, a polynucleotide of the disclosure further comprises at least one, two, three, four, five, six, seven, eight, nine, ten, or more of the same or different miRNA binding sites selected from Table 7, including any combination thereof. In some embodiments, the miRNA binding site binds to miR-142 or is complementary to miR-142. In some embodiments, the miR-142 comprises SEQ ID NO: 720. In some embodiments, the miRNA binding site binds to miR-142-3p or miR-142-5p. In some embodiments, the miR-142-3p binding site comprises SEQ ID NO: 721. In some embodiments, the miR-142-5p binding site comprises SEQ ID NO: 723. In some embodiments, the miRNA binding site comprises a nucleotide sequence at least 80%, at least 85%, at least 90%, at least 95%, or 100% identical to SEQ ID NO: 722 or SEQ ID NO: 724.

TABLE 7 miR-142 and miR-142 binding sites

| SEQ ID NO. | Description | Sequence |
|---|---|---|
| 720 | miR-142 | GACAGUGCAGUCACCCAUAAAGUAGAAAGCA CUACUAACAGCACUGGAGGGUGUAGUGUUUC CUACUUUAUGGAUGAGUGUACUGUG |
| 721 | miR-142-3p | UGUAGUGUUUCCUACUUUAUGGA |
| 722 | miR-142-3p binding site | UCCAUAAAGUAGGAAACACUACA |
| 723 | miR-142-5p | CAUAAAGUAGAAAGCACUACU |
| 724 | miR-142-5p binding site | AGUAGUGCUUUCUACUUUAUG |

In some embodiments, a miRNA binding site is inserted in the polynucleotide of the disclosure in any position of the polynucleotide (e.g., the 5'UTR and/or 3'UTR). In some embodiments, the 5'UTR comprises a miRNA binding site. In some embodiments, the 3'UTR comprises a miRNA binding site. In some embodiments, the 5'UTR and the 3'UTR comprise a miRNA binding site. The insertion site in the polynucleotide can be anywhere in the polynucleotide as long as the insertion of the miRNA binding site in the polynucleotide does not interfere with the translation of a functional polypeptide in the absence of the corresponding miRNA; and in the presence of the miRNA, the insertion of the miRNA binding site in the polynucleotide and the binding of the miRNA binding site to the corresponding miRNA are capable of degrading the polynucleotide or preventing the translation of the polynucleotide.

In some embodiments, a miRNA binding site is inserted in at least about 30 nucleotides downstream from the stop codon of an ORF in a polynucleotide of the disclosure comprising the ORF. In some embodiments, a miRNA binding site is inserted in at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides downstream from the stop codon of an ORF in a polynucleotide of the disclosure. In some embodiments, a miRNA binding site is inserted in about 10 nucleotides to about 100 nucleotides, about 20 nucleotides to about 90 nucleotides, about 30 nucleotides to about 80 nucleotides, about 40 nucleotides to about 70 nucleotides, about 50 nucleotides to about 60 nucleotides, about 45 nucleotides to about 65 nucleotides downstream from the stop codon of an ORF in a polynucleotide of the disclosure.

miRNA gene regulation can be influenced by the sequence surrounding the miRNA such as, but not limited to, the species of the surrounding sequence, the type of sequence (e.g., heterologous, homologous, exogenous, endogenous, or artificial), regulatory elements in the surrounding sequence and/or structural elements in the surrounding sequence. The miRNA can be influenced by the 5'UTR and/or 3'UTR. As a non-limiting example, a non-human 3'UTR can increase the regulatory effect of the miRNA sequence on the expression of a polypeptide of interest compared to a human 3'UTR of the same sequence type.

In one embodiment, other regulatory elements and/or structural elements of the 5'UTR can influence miRNA mediated gene regulation. One example of a regulatory element and/or structural element is a structured IRES (Internal Ribosome Entry Site) in the 5'UTR, which is necessary for the binding of translational elongation factors to initiate protein translation. EIF4A2 binding to this secondarily structured element in the 5'-UTR is necessary for miRNA mediated gene expression (Meijer H A et al., Science, 2013, 340, 82-85, herein incorporated by reference in its entirety). The polynucleotides of the disclosure can further include this structured 5'UTR in order to enhance microRNA mediated gene regulation.

At least one miRNA binding site can be engineered into the 3'UTR of a polynucleotide of the disclosure. In this context, at least two, at least three, at least four, at least five, at least six, at least seven, at least eight, at least nine, at least ten, or more miRNA binding sites can be engineered into a 3'UTR of a polynucleotide of the disclosure. For example, 1 to 10, 1 to 9, 1 to 8, 1 to 7, 1 to 6, 1 to 5, 1 to 4, 1 to 3, 2, or 1 miRNA binding sites can be engineered into the 3'UTR of a polynucleotide of the disclosure. In one embodiment, miRNA binding sites incorporated into a polynucleotide of the disclosure can be the same or can be different miRNA sites. A combination of different miRNA binding sites incorporated into a polynucleotide of the disclosure can include combinations in which more than one copy of any of the different miRNA sites are incorporated. In another embodiment, miRNA binding sites incorporated into a polynucleotide of the disclosure can target the same or different tissues in the body. As a non-limiting example, through the introduction of tissue-, cell-type-, or disease-specific miRNA binding sites in the 3'-UTR of a polynucleotide of the disclosure, the degree of expression in specific cell types (e.g., hepatocytes, myeloid cells, endothelial cells, cancer cells, etc.) can be reduced.

In one embodiment, a miRNA binding site can be engineered near the 5' terminus of the 3'UTR, about halfway between the 5' terminus and 3' terminus of the 3'UTR and/or near the 3' terminus of the 3'UTR in a polynucleotide of the disclosure. As a non-limiting example, a miRNA binding site can be engineered near the 5' terminus of the 3'UTR and about halfway between the 5' terminus and 3' terminus of the 3'UTR. As another non-limiting example, a miRNA binding site can be engineered near the 3' terminus of the 3'UTR and about halfway between the 5' terminus and 3' terminus of the 3'UTR. As yet another non-limiting example, a miRNA binding site can be engineered near the 5' terminus of the 3'UTR and near the 3' terminus of the 3'UTR.

In another embodiment, a 3'UTR can comprise 1, 2, 3, 4, 5, 6, 7, 8, 9, or 10 miRNA binding sites. The miRNA binding sites can be complementary to a miRNA, miRNA seed sequence, and/or miRNA sequences flanking the seed sequence.

In one embodiment, a polynucleotide of the disclosure can be engineered to include more than one miRNA site expressed in different tissues or different cell types of a subject. As a non-limiting example, a polynucleotide of the disclosure can be engineered to include miR-192 and miR-122 to regulate expression of the polynucleotide in the liver and kidneys of a subject. In another embodiment, a polynucleotide of the disclosure can be engineered to include more than one miRNA site for the same tissue.

In some embodiments, the therapeutic window and or differential expression associated with the polypeptide encoded by a polynucleotide of the disclosure can be altered with a miRNA binding site. For example, a polynucleotide encoding a polypeptide that provides a death signal can be designed to be more highly expressed in cancer cells by virtue of the miRNA signature of those cells. Where a cancer cell expresses a lower level of a particular miRNA, the polynucleotide encoding the binding site for that miRNA (or miRNAs) would be more highly expressed. Hence, the polypeptide that provides a death signal triggers or induces cell death in the cancer cell. Neighboring noncancer cells, harboring a higher expression of the same miRNA would be less affected by the encoded death signal as the polynucleotide would be expressed at a lower level due to the effects of the miRNA binding to the binding site or "sensor" encoded in the 3'UTR. Conversely, cell survival or cytoprotective signals can be delivered to tissues containing cancer and non-cancerous cells where a miRNA has a higher expression in the cancer cells—the result being a lower survival signal to the cancer cell and a larger survival signal to the normal cell. Multiple polynucleotides can be designed and administered having different signals based on the use of miRNA binding sites as described herein.

In some embodiments, the expression of a polynucleotide of the disclosure can be controlled by incorporating at least one sensor sequence in the polynucleotide and formulating the polynucleotide for administration. As a non-limiting example, a polynucleotide of the disclosure can be targeted to a tissue or cell by incorporating a miRNA binding site and formulating the polynucleotide in a lipid nanoparticle comprising a cationic lipid, including any of the lipids described herein.

A polynucleotide of the disclosure can be engineered for more targeted expression in specific tissues, cell types, or biological conditions based on the expression patterns of miRNAs in the different tissues, cell types, or biological conditions. Through introduction of tissue-specific miRNA binding sites, a polynucleotide of the disclosure can be designed for optimal protein expression in a tissue or cell, or in the context of a biological condition.

In some embodiments, a polynucleotide of the disclosure can be designed to incorporate miRNA binding sites that either have 100% identity to known miRNA seed sequences or have less than 100% identity to miRNA seed sequences. In some embodiments, a polynucleotide of the disclosure can be designed to incorporate miRNA binding sites that have at least: 60%, 65%, 70%, 75%, 80%, 85%, 90%, 95%, 96%, 97%, 98%, or 99% identity to known miRNA seed sequences. The miRNA seed sequence can be partially mutated to decrease miRNA binding affinity and as such result in reduced downmodulation of the polynucleotide. In essence, the degree of match or mis-match between the miRNA binding site and the miRNA seed can act as a rheostat to more finely tune the ability of the miRNA to modulate protein expression. In addition, mutation in the non-seed region of a miRNA binding site can also impact the ability of a miRNA to modulate protein expression.

In one embodiment, a miRNA sequence can be incorporated into the loop of a stem loop.

In another embodiment, a miRNA seed sequence can be incorporated in the loop of a stem loop and a miRNA binding site can be incorporated into the 5' or 3' stem of the stem loop.

In one embodiment, a translation enhancer element (TEE) can be incorporated on the 5'end of the stem of a stem loop and a miRNA seed can be incorporated into the stem of the stem loop. In another embodiment, a TEE can be incorporated on the 5' end of the stem of a stem loop, a miRNA seed can be incorporated into the stem of the stem loop and a miRNA binding site can be incorporated into the 3' end of the stem or the sequence after the stem loop. The miRNA seed and the miRNA binding site can be for the same and/or different miRNA sequences.

In one embodiment, the incorporation of a miRNA sequence and/or a TEE sequence changes the shape of the stem loop region which can increase and/or decrease translation. (see e.g, Kedde et al., "A Pumilio-induced RNA structure switch in p27-3'UTR controls miR-221 and miR-22 accessibility." Nature Cell Biology. 2010, incorporated herein by reference in its entirety).

In one embodiment, the 5'-UTR of a polynucleotide of the disclosure can comprise at least one miRNA sequence. The miRNA sequence can be, but is not limited to, a 19 or 22 nucleotide sequence and/or a miRNA sequence without the seed.

In one embodiment the miRNA sequence in the 5'UTR can be used to stabilize a polynucleotide of the disclosure described herein.

In another embodiment, a miRNA sequence in the 5'UTR of a polynucleotide of the disclosure can be used to decrease the accessibility of the site of translation initiation such as, but not limited to a start codon. See, e.g., Matsuda et al., PLoS One. 2010 11(5):e15057; incorporated herein by reference in its entirety, which used antisense locked nucleic acid (LNA) oligonucleotides and exon-junction complexes (EJCs) around a start codon (−4 to +37 where the A of the AUG codons is +1) in order to decrease the accessibility to the first start codon (AUG). Matsuda showed that altering the sequence around the start codon with an LNA or EJC affected the efficiency, length and structural stability of a polynucleotide. A polynucleotide of the disclosure can comprise a miRNA sequence, instead of the LNA or EJC sequence described by Matsuda et al, near the site of translation initiation in order to decrease the accessibility to the site of translation initiation. The site of translation initiation can be prior to, after or within the miRNA sequence. As a non-limiting example, the site of translation initiation can be located within a miRNA sequence such as a seed sequence or binding site. As another non-limiting example, the site of translation initiation can be located within a miR-122 sequence such as the seed sequence or the mir-122 binding site.

In some embodiments, a polynucleotide of the disclosure can include at least one miRNA in order to dampen the antigen presentation by antigen presenting cells. The miRNA can be the complete miRNA sequence, the miRNA seed sequence, the miRNA sequence without the seed, or a combination thereof. As a non-limiting example, a miRNA incorporated into a polynucleotide of the disclosure can be specific to the hematopoietic system. As another non-limiting example, a miRNA incorporated into a polynucleotide of the disclosure to dampen antigen presentation is miR-142-3p.

In some embodiments, a polynucleotide of the disclosure can include at least one miRNA in order to dampen expression of the encoded polypeptide in a tissue or cell of interest. As a non-limiting example, a polynucleotide of the disclosure can include at least one miR-122 binding site in order to dampen expression of an encoded polypeptide of interest in the liver. As another non-limiting example a polynucleotide of the disclosure can include at least one miR-142-3p binding site, miR-142-3p seed sequence, miR-142-3p binding site without the seed, miR-142-5p binding site, miR-142-5p seed sequence, miR-142-5p binding site without the seed, miR-146 binding site, miR-146 seed sequence and/or miR-146 binding site without the seed sequence.

In some embodiments, a polynucleotide of the disclosure can comprise at least one miRNA binding site in the 3'UTR in order to selectively degrade mRNA therapeutics in the immune cells to subdue unwanted immunogenic reactions caused by therapeutic delivery. As a non-limiting example, the miRNA binding site can make a polynucleotide of the disclosure more unstable in antigen presenting cells. Non-limiting examples of these miRNAs include mir-142-5p, mir-142-3p, mir-146a-5p, and mir-146-3p.

In one embodiment, a polynucleotide of the disclosure comprises at least one miRNA sequence in a region of the polynucleotide that can interact with a RNA binding protein.

In some embodiments, the polynucleotide of the disclosure (e.g., a RNA, e.g., a mRNA) comprising (i) a sequence-optimized nucleotide sequence (e.g., an ORF) encoding a MCM polypeptide (e.g., the wild-type sequence, functional fragment, or variant thereof) and (ii) a miRNA binding site (e.g., a miRNA binding site that binds to miR-142).

In some embodiments, the polynucleotide of the disclosure comprises a uracil-modified sequence encoding a MCM polypeptide disclosed herein and a miRNA binding site disclosed herein, e.g., a miRNA binding site that binds to miR-142. In some embodiments, the uracil-modified sequence encoding a MCM polypeptide comprises at least one chemically modified nucleobase, e.g., 5-methoxyuracil. In some embodiments, at least 95% of a type of nucleobase (e.g., uracil) in a uracil-modified sequence encoding a MCM polypeptide of the disclosure are modified nucleobases. In some embodiments, at least 95% of uracil in a uracil-modified sequence encoding a MCM polypeptide is 5-methoxyuridine. In some embodiments, the polynucleotide comprising a nucleotide sequence encoding a MCM polypeptide disclosed herein and a miRNA binding site is formulated with a delivery agent, e.g., a compound having the Formula (I), e.g., any of Compounds 1-147.

3' UTR and the AU Rich Elements

The disclosure also includes a polynucleotide that comprises both one or more 3' untranslated regions as well as the polynucleotide described herein, i.e., a polynucleotide comprising an ORF encoding an MCM polypeptide.

Natural or wild type 3' UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA (U/A)(U/A) nonamers. Molecules containing this type of AREs include GM-CSF and TNF-α. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides of the disclosure. When engineering specific polynucleotides, one or more copies of an ARE can be introduced to make polynucleotides of the disclosure less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using polynucleotides of the disclosure and protein production can be assayed at various time points post-transfection. For example, cells can be transfected with different ARE-engineering molecules and by using an ELISA kit to the relevant protein and assaying protein produced at 6 hour, 12 hour, 24 hour, 48 hour, and 7 days post-transfection.

Regions Having a 5' Cap

The disclosure also includes a polynucleotide that comprises both a 5' Cap and the polynucleotide described herein, i.e., a polynucleotide comprising an ORF encoding an MCM polypeptide.

The 5' cap structure of a natural mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns during mRNA splicing.

Endogenous mRNA molecules can be 5'-end capped generating a 5'-ppp-5'-triphosphate linkage between a terminal guanosine cap residue and the 5'-terminal transcribed sense nucleotide of the mRNA molecule. This 5'-guanylate cap can then be methylated to generate an N7-methyl-guanylate residue. The ribose sugars of the terminal and/or anteterminal transcribed nucleotides of the 5' end of the mRNA can optionally also be 2'-O-methylated. 5'-decapping through hydrolysis and cleavage of the guanylate cap structure can target a nucleic acid molecule, such as an mRNA molecule, for degradation.

In some embodiments, polynucleotides can be designed to incorporate a cap moiety. Modifications to the polynucleotides of the present disclosure can generate a non-hydrolyzable cap structure preventing decapping and thus increasing mRNA half-life. Because cap structure hydrolysis requires cleavage of 5'-ppp-5' phosphorodiester linkages, modified nucleotides can be used during the capping reaction. For example, a Vaccinia Capping Enzyme from New England Biolabs (Ipswich, Mass.) can be used with α-thio-guanosine nucleotides according to the manufacturer's instructions to create a phosphorothioate linkage in the 5'-ppp-5' cap. Additional modified guanosine nucleotides can be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide that functions as an mRNA molecule.

Cap analogs, which herein are also referred to as synthetic cap analogs, chemical caps, chemical cap analogs, or structural or functional cap analogs, differ from natural (i.e., endogenous, wild-type or physiological) 5'-caps in their chemical structure, while retaining cap function. Cap analogs can be chemically (i.e., non-enzymatically) or enzymatically synthesized and/or linked to the polynucleotides of the disclosure.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3'mppp-G; which can equivalently be designated 3' O-Me-m7G(5')ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, m$^7$Gm-ppp-G).

In some embodiments, the cap is a dinucleotide cap analog. As a non-limiting example, the dinucleotide cap analog can be modified at different phosphate positions with a boranophosphate group or a phophoroselenoate group such as the dinucleotide cap analogs described in U.S. Pat. No. 8,519,110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dicucleotide form of a cap analog include a N7-(4-chlorophenoxyethyl)-G(5')ppp(5')G and a N7-(4-chlorophenoxyethyl)-m$^{3'-O}$G(5')ppp(5')G cap analog (See, e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present disclosure is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, can lead to reduced translational competency and reduced cellular stability.

Polynucleotides of the disclosure can also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present disclosure are those that, among other things, have enhanced binding of cap binding proteins, increased half-life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5')ppp(5')N,pN2p (cap 0), 7mG(5')ppp(5')NlmpNp (cap 1), and 7mG(5')-ppp(5')NlmpN2mp (cap 2).

As a non-limiting example, capping chimeric polynucleotides post-manufacture can be more efficient as nearly 100% of the chimeric polynucleotides can be capped. This is in contrast to ~80% when a cap analog is linked to a chimeric polynucleotide in the course of an in vitro transcription reaction.

According to the present disclosure, 5' terminal caps can include endogenous caps or cap analogs. According to the present disclosure, a 5' terminal cap can comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

Poly-A Tails

The disclosure also includes a polynucleotide that comprises both a poly-A tail and the polynucleotide described herein, i.e., a polynucleotide comprising an ORF encoding an MCM polypeptide.

During RNA processing, a long chain of adenine nucleotides (poly-A tail) can be added to a polynucleotide such as an mRNA molecule in order to increase stability. Immediately after transcription, the 3' end of the transcript can be cleaved to free a 3' hydroxyl. Then poly-A polymerase adds a chain of adenine nucleotides to the RNA. The process, called polyadenylation, adds a poly-A tail that can be between, for example, approximately 80 to approximately 250 residues long, including approximately 80, 90, 100, 110, 120, 130, 140, 150, 160, 170, 180, 190, 200, 210, 220, 230, 240 or 250 residues long.

PolyA tails can also be added after the construct is exported from the nucleus.

According to the present disclosure, terminal groups on the poly A tail can be incorporated for stabilization. Polynucleotides of the present disclosure can include des-3' hydroxyl tails. They can also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present disclosure can be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present disclosure.

Generally, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In some embodiments, the poly-A tail is designed relative to the length of the overall polynucleotide or the length of a particular region of the polynucleotide. This design can be based on the length of a coding region, the length of a particular feature or region or based on the length of the ultimate product expressed from the polynucleotides.

In this context, the poly-A tail can be 10, 20, 30, 40, 50, 60, 70, 80, 90, or 100% greater in length than the polynucleotide or feature thereof. The poly-A tail can also be designed as a fraction of the polynucleotides to which it belongs. In this context, the poly-A tail can be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein can enhance expression.

Additionally, multiple distinct polynucleotides can be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In some embodiments, the polynucleotides of the present disclosure are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

Start Codon Region

The disclosure also includes a polynucleotide that comprises both a start codon region and the polynucleotide described herein, i.e., a polynucleotide comprising an ORF encoding an MCM polypeptide. In some embodiments, the polynucleotides of the present disclosure can have regions that are analogous to or function like a start codon region.

In some embodiments, the translation of a polynucleotide can initiate on a codon that is not the start codon AUG. Translation of the polynucleotide can initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety). As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See, e.g., Matsuda and Mauro PLoS ONE, 2010 5:11; the contents of which are herein incorporated by reference in its entirety). Masking any of the nucleotides flanking a codon that initiates translation can be used to alter the position of translation initiation, translation efficiency, length and/or structure of a polynucleotide.

In some embodiments, a masking agent can be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs) (See, e.g., Matsuda and Mauro describing masking agents LNA polynucleotides and EJCs (PLoS ONE, 2010 5:11); the contents of which are herein incorporated by reference in its entirety).

In another embodiment, a masking agent can be used to mask a start codon of a polynucleotide in order to increase the likelihood that translation will initiate on an alternative start codon.

In some embodiments, a masking agent can be used to mask a first start codon or alternative start codon in order to increase the chance that translation will initiate on a start codon or alternative start codon downstream to the masked start codon or alternative start codon.

In some embodiments, a start codon or alternative start codon can be located within a perfect complement for a miR binding site. The perfect complement of a miR binding site can help control the translation, length and/or structure of the polynucleotide similar to a masking agent. As a non-limiting example, the start codon or alternative start codon can be located in the middle of a perfect complement for a miR-122 binding site. The start codon or alternative start codon can be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide can be removed from the polynucleotide sequence in order to have the translation of the polynucleotide begin on a codon that is not the start codon. Translation of the polynucleotide can begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed can further comprise at least one masking agent for the downstream start codon and/or alternative start codons in order to control or attempt to control the initiation of translation, the length of the polynucleotide and/or the structure of the polynucleotide.

Stop Codon Region

The disclosure also includes a polynucleotide that comprises both a stop codon region and the polynucleotide described herein, i.e., a polynucleotide comprising an ORF encoding an MCM polypeptide. In some embodiments, the polynucleotides of the present disclosure can include at least two stop codons before the 3' untranslated region (UTR). The stop codon can be selected from TGA, TAA and TAG. In some embodiments, the polynucleotides of the present disclosure include the stop codon TGA and one additional stop codon. In a further embodiment the addition stop codon can be TAA. In another embodiment, the polynucleotides of the present disclosure include three stop codons.

Insertions and Substitutions

The disclosure also includes a polynucleotide that comprises insertions and/or substitutions in the polynucleotide described herein, i.e., a polynucleotide comprising an ORF encoding an MCM polypeptide.

In some embodiments, the 5'UTR of the polynucleotide can be replaced by the insertion of at least one region and/or string of nucleosides of the same base. The region and/or string of nucleotides can include, but is not limited to, at least 3, at least 4, at least 5, at least 6, at least 7 or at least 8 nucleotides and the nucleotides can be natural and/or unnatural. As a non-limiting example, the group of nucleotides can include 5-8 adenine, cytosine, thymine, a string of any of the other nucleotides disclosed herein and/or combinations thereof.

In some embodiments, the 5'UTR of the polynucleotide can be replaced by the insertion of at least two regions and/or strings of nucleotides of two different bases such as, but not limited to, adenine, cytosine, thymine, any of the other nucleotides disclosed herein and/or combinations thereof. For example, the 5'UTR can be replaced by inserting 5-8 adenine bases followed by the insertion of 5-8 cytosine bases. In another example, the 5'UTR can be replaced by inserting 5-8 cytosine bases followed by the insertion of 5-8 adenine bases.

In some embodiments, the polynucleotide can include at least one substitution and/or insertion downstream of the transcription start site that can be recognized by an RNA polymerase. As a non-limiting example, at least one substitution and/or insertion can occur downstream of the transcription start site by substituting at least one nucleic acid in the region just downstream of the transcription start site (such as, but not limited to, +1 to +6). Changes to region of nucleotides just downstream of the transcription start site can affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside can cause a silent mutation of the sequence or can cause a mutation in the amino acid sequence.

In some embodiments, the polynucleotide can include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In some embodiments, the polynucleotide can include the substitution of at least 1, at least 2, at least 3, at least 4, at least 5 or at least 6 guanine bases in the region just downstream of the transcription start site. As a non-limiting example, if the nucleotides in the region are GGGAGA, the guanine bases can be substituted by at least 1, at least 2, at least 3 or at least 4 adenine nucleotides. In another non-limiting example, if the nucleotides in the region are GGGAGA the guanine bases can be substituted by at least 1, at least 2, at least 3 or at least 4 cytosine bases. In another non-limiting example, if the nucleotides in the region are GGGAGA the guanine bases can be substituted by at least 1, at least 2, at least 3 or at least 4 thymine, and/or any of the nucleotides described herein.

In some embodiments, the polynucleotide can include at least one substitution and/or insertion upstream of the start codon. For the purpose of clarity, one of skill in the art would appreciate that the start codon is the first codon of the protein coding region whereas the transcription start site is the site where transcription begins. The polynucleotide can include, but is not limited to, at least 1, at least 2, at least 3, at least 4, at least 5, at least 6, at least 7 or at least 8 substitutions and/or insertions of nucleotide bases. The nucleotide bases can be inserted or substituted at 1, at least 1, at least 2, at least 3, at least 4 or at least 5 locations upstream of the start codon. The nucleotides inserted and/or substituted can be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the polynucleotide can be substituted with adenine, cytosine, thymine, or any of the nucleotides described herein. In another non-limiting example the substitution of guanine bases in the polynucleotide can be designed so as to leave one guanine base in the region downstream of the transcription start site and before the start codon (see Esvelt et al. Nature (2011) 472(7344): 499-503; the contents of which is herein incorporated by reference in its entirety). As a non-limiting example, at least 5 nucleotides can be inserted at 1 location downstream of the transcription start site but upstream of the start codon and the at least 5 nucleotides can be the same base type.

IV. Methods of Making Polynucleotides

The present disclosure also provides methods for making a polynucleotide disclosed herein or a complement thereof. In some aspects, a polynucleotide (e.g., an mRNA) disclosed herein, and encoding an MCM polypeptide or a functional fragment thereof, can be constructed using in vitro transcription. In other aspects, a polynucleotide (e.g., an mRNA) disclosed herein, and encoding an MCM polypeptide or a functional fragment thereof, can be constructed by chemical synthesis using an oligonucleotide synthesizer. In other aspects, a polynucleotide (e.g., an mRNA) disclosed herein, and encoding an MCM polypeptide or a functional fragment thereof is made by using a host cell. In certain aspects, a polynucleotide (e.g., an mRNA) disclosed herein, and encoding an MCM polypeptide or a functional fragment thereof is made by one or more combination of the IVT, chemical synthesis, host cell expression, or any other methods known in the art.

Naturally occurring nucleosides, non-naturally occurring nucleosides, or combinations thereof, can totally or partially naturally replace occurring nucleosides present in the candidate nucleotide sequence and can be incorporated into a sequence-optimized nucleotide sequence (e.g., an mRNA) encoding an MCM polypeptide. The resultant mRNAs can then be examined for their ability to produce protein and/or produce a therapeutic outcome.

In Vitro Transcription-Enzymatic Synthesis

A polynucleotide disclosed herein can be transcribed using an in vitro transcription (IVT) system. The system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate modified nucleic acids. See U.S. Publ. No. US20130259923, which is herein incorporated by reference in its entirety.

The IVT system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate polynucleotides disclosed herein.

Any number of RNA polymerases or variants can be used in the synthesis of the polynucleotides of the present disclosure.

RNA polymerases can be modified by inserting or deleting amino acids of the RNA polymerase sequence. As a non-limiting example, the RNA polymerase can be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants can be obtained by evolving an RNA polymerase, optimizing the RNA polymerase amino acid and/or nucleic acid sequence and/or by using other methods known in the art. As a non-limiting example, T7 RNA polymerase variants can be evolved using the continuous directed evolution system set out by Esvelt et al. (Nature (2011) 472 (7344):499-503; herein incorporated by reference in its entirety) where clones of T7 RNA polymerase can encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants can encode at least mutation as described in U.S. Pub. Nos. 20100120024 and 20070117112; herein incorporated by reference in their entireties. Variants of RNA polymerase can also include, but are not limited to, substitutional variants, conservative amino acid substitution, insertional variants, deletional variants and/or covalent derivatives.

In one aspect, the polynucleotide can be designed to be recognized by the wild type or variant RNA polymerases. In doing so, the polynucleotide can be modified to contain sites or regions of sequence changes from the wild type or parent chimeric polynucleotide.

Polynucleotide or nucleic acid synthesis reactions can be carried out by enzymatic methods utilizing polymerases. Polymerases catalyze the creation of phosphodiester bonds between nucleotides in a polynucleotide or nucleic acid chain. Currently known DNA polymerases can be divided into different families based on amino acid sequence comparison and crystal structure analysis. DNA polymerase I (pol I) or A polymerase family, including the Klenow fragments of *E. Coli, Bacillus* DNA polymerase I, *Thermus aquaticus* (Taq) DNA polymerases, and the T7 RNA and DNA polymerases, is among the best studied of these families. Another large family is DNA polymerase α (pol α) or B polymerase family, including all eukaryotic replicating DNA polymerases and polymerases from phages T4 and RB69. Although they employ similar catalytic mechanism, these families of polymerases differ in substrate specificity, substrate analog-incorporating efficiency, degree and rate for primer extension, mode of DNA synthesis, exonuclease activity, and sensitivity against inhibitors.

DNA polymerases are also selected based on the optimum reaction conditions they require, such as reaction temperature, pH, and template and primer concentrations. Sometimes a combination of more than one DNA polymerases is employed to achieve the desired DNA fragment size and synthesis efficiency. For example, Cheng et al. increase pH, add glycerol and dimethyl sulfoxide, decrease denaturation times, increase extension times, and utilize a secondary thermostable DNA polymerase that possesses a 3' to 5' exonuclease activity to effectively amplify long targets from cloned inserts and human genomic DNA. (Cheng et al., PNAS, Vol. 91, 5695-5699 (1994), the contents of which are incorporated herein by reference in their entirety). RNA polymerases from bacteriophage T3, T7, and SP6 have been widely used to prepare RNAs for biochemical and biophysical studies. RNA polymerases, capping enzymes, and poly-A polymerases are disclosed in the co-pending International Publication No. WO2014028429, the contents of which are incorporated herein by reference in their entirety.

In one aspect, the RNA polymerase which can be used in the synthesis of the polynucleotides described herein is a Syn5 RNA polymerase. (see Zhu et al. Nucleic Acids Research 2013, the contents of which is herein incorporated by reference in its entirety). The Syn5 RNA polymerase was recently characterized from marine cyanophage Syn5 by Zhu et al. where they also identified the promoter sequence (see Zhu et al. Nucleic Acids Research 2013, the contents of which is herein incorporated by reference in its entirety). Zhu et al. found that Syn5 RNA polymerase catalyzed RNA synthesis over a wider range of temperatures and salinity as compared to T7 RNA polymerase. Additionally, the requirement for the initiating nucleotide at the promoter was found to be less stringent for Syn5 RNA polymerase as compared to the T7 RNA polymerase making Syn5 RNA polymerase promising for RNA synthesis.

In one aspect, a Syn5 RNA polymerase can be used in the synthesis of the polynucleotides described herein. As a non-limiting example, a Syn5 RNA polymerase can be used in the synthesis of the polynucleotide requiring a precise 3'-termini.

In one aspect, a Syn5 promoter can be used in the synthesis of the polynucleotides. As a non-limiting example, the Syn5 promoter can be 5"-ATTGGGCACCCG-TAAGGG-3' (SEQ ID NO:775) as described by Zhu et al. (Nucleic Acids Research 2013, the contents of which is herein incorporated by reference in its entirety).

In one aspect, a Syn5 RNA polymerase can be used in the synthesis of polynucleotides comprising at least one chemical modification described herein and/or known in the art. (see e.g., the incorporation of pseudo-UTP and 5Me-CTP described in Zhu et al. Nucleic Acids Research 2013, the contents of which is herein incorporated by reference in its entirety).

In one aspect, the polynucleotides described herein can be synthesized using a Syn5 RNA polymerase which has been purified using modified and improved purification procedure described by Zhu et al. (Nucleic Acids Research 2013, the contents of which is herein incorporated by reference in its entirety).

Various tools in genetic engineering are based on the enzymatic amplification of a target gene which acts as a template. For the study of sequences of individual genes or specific regions of interest and other research needs, it is necessary to generate multiple copies of a target gene from a small sample of polynucleotides or nucleic acids. Such methods can be applied in the manufacture of the polynucleotides of the disclosure.

Polymerase chain reaction (PCR) has wide applications in rapid amplification of a target gene, as well as genome mapping and sequencing. The key components for synthesizing DNA comprise target DNA molecules as a template, primers complementary to the ends of target DNA strands, deoxynucleoside triphosphates (dNTPs) as building blocks, and a DNA polymerase. As PCR progresses through denaturation, annealing and extension steps, the newly produced DNA molecules can act as a template for the next circle of replication, achieving exponentially amplification of the target DNA. PCR requires a cycle of heating and cooling for denaturation and annealing. Variations of the basic PCR include asymmetric PCR [Innis et al., PNAS, vol. 85, 9436-9440 (1988)], inverse PCR [Ochman et al., Genetics, vol. 120(3), 621-623, (1988)], reverse transcription PCR (RT-PCR) (Freeman et al., BioTechniques, vol. 26(1), 112-22, 124-5 (1999), the contents of which are incorporated herein by reference in their entirety and so on). In RT-PCR, a single stranded RNA is the desired target and is converted to a double stranded DNA first by reverse transcriptase.

A variety of isothermal in vitro nucleic acid amplification techniques have been developed as alternatives or complements of PCR. For example, strand displacement amplification (SDA) is based on the ability of a restriction enzyme to form a nick. (Walker et al., PNAS, vol. 89, 392-396 (1992), the contents of which are incorporated herein by reference in their entirety)). A restriction enzyme recognition sequence is inserted into an annealed primer sequence. Primers are extended by a DNA polymerase and dNTPs to form a duplex. Only one strand of the duplex is cleaved by the restriction enzyme. Each single strand chain is then available as a template for subsequent synthesis. SDA does not require the complicated temperature control cycle of PCR.

Nucleic acid sequence-based amplification (NASBA), also called transcription mediated amplification (TMA), is also an isothermal amplification method that utilizes a combination of DNA polymerase, reverse transcriptase, RNAse H, and T7 RNA polymerase. [Compton, Nature, vol. 350, 91-92 (1991)] the contents of which are incorporated herein by reference in their entirety. A target RNA is used as a template and a reverse transcriptase synthesizes its complementary DNA strand. RNAse H hydrolyzes the RNA template, making space for a DNA polymerase to synthesize a DNA strand complementary to the first DNA strand which is complementary to the RNA target, forming a DNA duplex. T7 RNA polymerase continuously generates complementary RNA strands of this DNA duplex. These RNA strands act as templates for new cycles of DNA synthesis, resulting in amplification of the target gene.

Rolling-circle amplification (RCA) amplifies a single stranded circular polynucleotide and involves numerous rounds of isothermal enzymatic synthesis where D29 DNA polymerase extends a primer by continuously progressing around the polynucleotide circle to replicate its sequence over and over again. Therefore, a linear copy of the circular template is achieved. A primer can then be annealed to this linear copy and its complementary chain can be synthesized. [See Lizardi et al., Nature Genetics, vol. 19, 225-232 (1998)] the contents of which are incorporated herein by reference in their entirety. A single stranded circular DNA can also serve as a template for RNA synthesis in the presence of an RNA polymerase. (Daubendiek et al., JACS, vol. 117, 7818-7819 (1995), the contents of which are incorporated herein by reference in their entirety). An inverse rapid amplification of cDNA ends (RACE) RCA is described by Polidoros et al. A messenger RNA (mRNA) is reverse transcribed into cDNA, followed by RNAse H treatment to separate the cDNA. The cDNA is then circularized by CircLigase into a circular DNA. The amplification of the resulting circular DNA is achieved with RCA. (Polidoros et al., BioTechniques, vol. 41, 35-42 (2006), the contents of which are incorporated herein by reference in their entirety).

Any of the foregoing methods can be utilized in the manufacture of one or more regions of the polynucleotides of the present disclosure.

Assembling polynucleotides or nucleic acids by a ligase is also widely used. DNA or RNA ligases promote intermolecular ligation of the 5' and 3' ends of polynucleotide chains through the formation of a phosphodiester bond. Ligase chain reaction (LCR) is a promising diagnosing technique based on the principle that two adjacent polynucleotide probes hybridize to one strand of a target gene and couple to each other by a ligase. If a target gene is not present, or if there is a mismatch at the target gene, such as a single-nucleotide polymorphism (SNP), the probes cannot ligase. (Wiedmann et al., PCR Methods and Application, vol. 3 (4), s51-s64 (1994), the contents of which are incorporated herein by reference in their entirety). LCR can be combined with various amplification techniques to increase sensitivity of detection or to increase the amount of products if it is used in synthesizing polynucleotides and nucleic acids.

Several library preparation kits for nucleic acids are now commercially available. They include enzymes and buffers to convert a small amount of nucleic acid samples into an indexed library for downstream applications. For example, DNA fragments can be placed in a NEBNEXT® ULTRA™ DNA Library Prep Kit by NEWENGLAND BIOLABS® for end preparation, ligation, size selection, clean-up, PCR amplification and final clean-up.

Continued development is going on to improvement the amplification techniques. For example, U.S. Pat. No. 8,367,328 to Asada et al. the contents of which are incorporated herein by reference in their entirety, teaches utilizing a reaction enhancer to increase the efficiency of DNA synthesis reactions by DNA polymerases. The reaction enhancer comprises an acidic substance or cationic complexes of an acidic substance. U.S. Pat. No. 7,384,739 to Kitabayashi et al. the contents of which are incorporated herein by reference in their entirety, teaches a carboxylate ion-supplying substance that promotes enzymatic DNA synthesis, wherein the carboxylate ion-supplying substance is selected from oxalic acid, malonic acid, esters of oxalic acid, esters of malonic acid, salts of malonic acid, and esters of maleic acid. U.S. Pat. No. 7,378,262 to Sobek et al. the contents of which are incorporated herein by reference in their entirety, discloses an enzyme composition to increase fidelity of DNA amplifications. The composition comprises one enzyme with 3' exonuclease activity but no polymerase activity and another enzyme that is a polymerase. Both of the enzymes are thermostable and are reversibly modified to be inactive at lower temperatures.

U.S. Pat. No. 7,550,264 to Getts et al. teaches multiple round of synthesis of sense RNA molecules are performed by attaching oligodeoxynucleotides tails onto the 3' end of cDNA molecules and initiating RNA transcription using RNA polymerase, the contents of which are incorporated herein by reference in their entirety. US Pat. Publication No. 2013/0183718 to Rohayem teaches RNA synthesis by RNA-dependent RNA polymerases (RdRp) displaying an RNA polymerase activity on single-stranded DNA templates, the contents of which are incorporated herein by reference in their entirety. Oligonucleotides with non-standard nucleotides can be synthesized with enzymatic polymerization by contacting a template comprising non-standard nucleotides with a mixture of nucleotides that are complementary to the nucleotides of the template as disclosed in U.S. Pat. No. 6,617,106 to Benner, the contents of which are incorporated herein by reference in their entirety.

Chemical Synthesis

Standard methods can be applied to synthesize an isolated polynucleotide sequence encoding an isolated polypeptide of interest. For example, a single DNA or RNA oligomer containing a codon-optimized nucleotide sequence coding for the particular isolated polypeptide can be synthesized. In other aspects, several small oligonucleotides coding for portions of the desired polypeptide can be synthesized and then ligated. In some aspects, the individual oligonucleotides typically contain 5' or 3' overhangs for complementary assembly.

A polynucleotide disclosed herein (e.g., mRNA) can be chemically synthesized using chemical synthesis methods and potential nucleobase substitutions known in the art. See, for example, International Publication Nos. WO2014093924, WO2013052523; WO2013039857, WO2012135805, WO2013151671; U.S. Publ. No. US20130115272; or U.S. Pat. Nos. 8,999,380, 8,710,200, all of which are herein incorporated by reference in their entireties.

V. Purification and Quantitation of Polynucleotides

Purification

Purification of the polynucleotides described herein (i.e., a polynucleotide comprising an ORF encoding an MCM polypeptide) can include, but is not limited to, polynucleotide clean-up, quality assurance and quality control. Clean-up can be performed by methods known in the arts such as, but not limited to, AGENCOURT® beads (Beckman Coulter Genomics, Danvers, Mass.), poly-T beads, LNA™ oligo-T capture probes (EXIQON® Inc., Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified polynucleotide" refers to one that is separated from at least one contaminant. As used herein, a "contaminant" is any substance that makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

In some embodiments, purification of a polynucleotide of the disclosure removes impurities that can reduce or remove an unwanted immune response, e.g., reducing cytokine activity.

In some embodiments, the polynucleotide of the disclosure is purified prior to administration using column chromatography (e.g., strong anion exchange HPLC, weak anion exchange HPLC, reverse phase HPLC (RP-HPLC), and hydrophobic interaction HPLC (HIC-HPLC), or (LCMS)). In some embodiments, a column chromatography (e.g., strong anion exchange HPLC, weak anion exchange HPLC, reverse phase HPLC (RP-HPLC), and hydrophobic interaction HPLC (HIC-HPLC), or (LCMS)) purified polynucleotide, that encodes an MCM polypeptide disclosed herein increases expression of MCM compared to polynucleotides encoding MCM purified by a different purification method. In some embodiments, a column chromatography (e.g., strong anion exchange HPLC, weak anion exchange HPLC, reverse phase HPLC (RP-HPLC), and hydrophobic interaction HPLC (HIC-HPLC), or (LCMS)) purified polynucleotide encodes an MCM polypeptide or functional fragment thereof comprising one or more of the point mutations V69, T499, H532, A598, and V671. In some embodiments, the RP-HPLC purified polynucleotide increases MCM expression (e.g., by 20-50%, at least 20%, at least 25%, at least 30%, at least 35%, at least 40%, at least 45%, or at least 50%).

A quality assurance and/or quality control check can be conducted using methods such as, but not limited to, gel electrophoresis, UV absorbance, or analytical HPLC.

In another embodiment, the polynucleotides can be sequenced by methods including, but not limited to reverse-transcriptase-PCR.

Quantification

In some embodiments, the polynucleotides of the present disclosure (i.e., a polynucleotide comprising an ORF encoding an MCM polypeptide) can be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes can be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide can be an expression level, presence, absence, truncation or alteration of the administered construct. It is advantageous to correlate the level with one or more clinical phenotypes or with an assay for a human disease biomarker. The assay can be performed using construct specific probes, cytometry, qRT-PCR, real-time PCR, PCR, flow cytometry, electrophoresis, mass spectrometry, or combinations thereof while the exosomes can be isolated using immunohistochemical methods such as enzyme linked immunosorbent assay (ELISA) methods. Exosomes can also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present disclosure differ from the endogenous forms due to the structural or chemical modifications.

In some embodiments, the polynucleotide can be quantified using methods such as, but not limited to, ultraviolet visible spectroscopy (UV/Vis). A non-limiting example of a UV/Vis spectrometer is a NANODROP® spectrometer (ThermoFisher, Waltham, Mass.). The quantified polynucleotide can be analyzed in order to determine if the polynucleotide can be of proper size, check that no degradation of the polynucleotide has occurred. Degradation of the polynucleotide can be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

VI. Pharmaceutical Compositions

The disclosure includes pharmaceutical compositions that comprise the polynucleotide described herein, i.e., a polynucleotide comprising an ORF encoding an MCM polypeptide. In some embodiments, the formulation can contain polynucleotide encoding wild type MCM or MCM comprising a nucleotide sequence having significant sequence similarity to a polynucleotide selected from the group of SEQ ID NOs: 1-207, 732-765, and 772, wherein the ORF encodes an MCM polypeptide.

Pharmaceutical compositions can optionally comprise one or more additional active substances, e.g., therapeutically and/or prophylactically active substances. Pharmaceutical compositions of the present disclosure can be sterile and/or pyrogen-free. General considerations in the formulation and/or manufacture of pharmaceutical agents can be found, for example, in *Remington: The Science and Practice of Pharmacy* $21^{st}$ ed., Lippincott Williams & Wilkins, 2005 (incorporated herein by reference in its entirety). For the purposes of the present disclosure, the phrase "active ingredient" generally refers to polynucleotides to be delivered as described herein.

Formulations of the pharmaceutical compositions described herein can be prepared by any method known or hereafter developed in the art of pharmacology. In general, such preparatory methods include the step of associating the active ingredient with an excipient and/or one or more other accessory ingredients.

A pharmaceutical composition in accordance with the present disclosure can be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient that would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure can vary, depending upon the identity, size, and/or condition of the subject being treated and further depending upon the route by which the composition is to be administered. For example, the composition can comprise between 0.1% and 99% (w/w) of the active ingredient. By way of example, the composition can comprise between 0.1% and 100%, e.g., between 0.5 and 50%, between 1-30%, between 5-80%, at least 80% (w/w) active ingredient.

In some embodiments, the formulations described herein can contain at least one polynucleotide. As a non-limiting example, the formulations can contain 1, 2, 3, 4 or 5 polynucleotides.

In some embodiments, the formulations described herein can comprise more than one type of polynucleotide. In some embodiments, the formulation can comprise a polynucleotide in linear and circular form. In another embodiment, the formulation can comprise a circular polynucleotide and an IVT polynucleotide. In yet another embodiment, the formulation can comprise an IVT polynucleotide, a chimeric polynucleotide and a circular polynucleotide.

In some embodiments, compositions are administered to humans, human patients or subjects. Although the descriptions of pharmaceutical compositions provided herein are principally directed to pharmaceutical compositions that are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Delivery Agents a. Lipid Compound

The present disclosure provides pharmaceutical compositions with advantageous properties. In particular, the present application provides pharmaceutical compositions comprising:

(a) a polynucleotide comprising an ORF encoding an MCM polypeptide; and (b) a lipid compound having the formula (I)

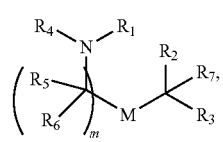

(I)

wherein $R_1$ is selected from the group consisting of $C_{5\text{-}20}$ alkyl, $C_{5\text{-}20}$ alkenyl, —R*YR", —YR", and —R"M'R';

$R_2$ and $R_3$ are independently selected from the group consisting of H, $C_{1\text{-}14}$ alkyl, $C_{2\text{-}14}$ alkenyl, —R*YR", —YR", and —R*OR", or $R_2$ and $R_3$, together with the atom to which they are attached, form a heterocycle or carbocycle;

$R_4$ is selected from the group consisting of a $C_{3\text{-}6}$ carbocycle, —(CH$_2$)$_n$Q, —(CH$_2$)$_n$CHQR, —CHQR, —CQ(R)$_2$, and unsubstituted $C_{1\text{-}6}$ alkyl, where Q is selected from a carbocycle, heterocycle, —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, and —C(R)N(R)$_2$C(O)OR, and each n is independently selected from 1, 2, 3, 4, and 5;

each $R_5$ is independently selected from the group consisting of $C_{1\text{-}3}$ alkyl, $C_{2\text{-}3}$ alkenyl, and H;

each $R_6$ is independently selected from the group consisting of $C_{1\text{-}3}$ alkyl, $C_{2\text{-}3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

R$_7$ is selected from the group consisting of C$_{1-3}$ alkyl, C$_{2-3}$ alkenyl, and H;

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13, or salts or stereoisomers thereof, wherein alkyl and alkenyl groups can be linear or branched.

In some embodiments, a subset of compounds of Formula (I) includes those in which when R$_4$ is —(CH$_2$)$_n$Q, —(CH$_2$)$_n$CHQR, —CHQR, or —CQ(R)$_2$, then (i) Q is not —N(R)$_2$ when n is 1, 2, 3, 4 or 5, or (ii) Q is not 5, 6, or 7-membered heterocycloalkyl when n is 1 or 2.

In another embodiments, another subset of compounds of Formula (I) includes those in which R$_1$ is selected from the group consisting of C$_{5-20}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle;

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, and a 5- to 14-membered heterocycloalkyl having one or more heteroatoms selected from N, O, and S which is substituted with one or more substituents selected from oxo (=O), OH, amino, and C$_{1-3}$ alkyl, and each n is independently selected from 1, 2, 3, 4, and 5;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

R$_7$ is selected from the group consisting of C$_{1-3}$ alkyl, C$_{2-3}$ alkenyl, and H;

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which R$_1$ is selected from the group consisting of C$_{5-20}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle;

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heterocycle having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, and each n is independently selected from 1, 2, 3, 4, and 5; and when Q is a 5- to 14-membered heterocycle and (i) R$_4$ is —(CH$_2$)$_n$Q in which n is 1 or 2, or (ii) R$_4$ is —(CH$_2$)$_n$CHQR in which n is 1, or (iii) R$_4$ is —CHQR, and —CQ(R)$_2$, then Q is either a 5- to 14-membered heteroaryl or 8- to 14-membered heterocycloalkyl;

each R$_5$ is independently selected from the group consisting of C$_{1-3}$ alkyl, C$_{2-3}$ alkenyl, and H;

each R$_6$ is independently selected from the group consisting of C$_{1-3}$ alkyl, C$_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

R$_7$ is selected from the group consisting of C$_{1-3}$ alkyl, C$_{2-3}$ alkenyl, and H;

each R is independently selected from the group consisting of C$_{1-3}$ alkyl, C$_{2-3}$ alkenyl, and H;

each R' is independently selected from the group consisting of C$_{1-18}$ alkyl, C$_{2-18}$ alkenyl, —R*YR", —YR", and H;

each R" is independently selected from the group consisting of C$_{3-14}$ alkyl and C$_{3-14}$ alkenyl;

each R* is independently selected from the group consisting of C$_{1-12}$ alkyl and C$_{2-12}$ alkenyl;

each Y is independently a C$_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In still another embodiments, another subset of compounds of Formula (I) includes those in which R$_1$ is selected from the group consisting of C$_{5-20}$ alkyl, C$_{5-20}$ alkenyl, —R*YR", —YR", and —R"M'R';

R$_2$ and R$_3$ are independently selected from the group consisting of H, C$_{1-14}$ alkyl, C$_{2-14}$ alkenyl, —R*YR", —YR", and —R*OR", or R$_2$ and R$_3$, together with the atom to which they are attached, form a heterocycle or carbocycle;

R$_4$ is selected from the group consisting of a C$_{3-6}$ carbocycle, —(CH$_2$)$_n$Q, —(CH$_2$)$_n$CHQR, —CHQR, —CQ(R)$_2$, and unsubstituted C$_{1-6}$ alkyl, where Q is selected from a C$_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —CRN(R)$_2$C(O)OR, and each n is independently selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{2-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In yet another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of H, $C_{2-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is —(CH$_2$)$_n$Q or —(CH$_2$)$_n$CHQR, where Q is —N(R)$_2$, and n is selected from 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In still another embodiments, another subset of compounds of Formula (I) includes those in which $R_1$ is selected from the group consisting of $C_{5-20}$ alkyl, $C_{5-20}$ alkenyl, —R*YR", —YR", and —R"M'R';

$R_2$ and $R_3$ are independently selected from the group consisting of $C_{1-14}$ alkyl, $C_{2-14}$ alkenyl, —R*YR", —YR", and —R*OR", or $R_2$ and $R_3$, together with the atom to which they are attached, form a heterocycle or carbocycle;

$R_4$ is selected from the group consisting of —(CH$_2$)$_n$Q, —(CH$_2$)$_n$CHQR, —CHQR, and —CQ(R)$_2$, where Q is —N(R)$_2$, and n is selected from 1, 2, 3, 4, and 5;

each $R_5$ is independently selected from the group consisting of $C_{1-3}$ alkyl, $C_{2-3}$ alkenyl, and H;

each $R_6$ is independently selected from the group consisting of $C_{1-3}$ alkyl, $C_{2-3}$ alkenyl, and H;

M and M' are independently selected from —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group;

$R_7$ is selected from the group consisting of $C_{1-3}$ alkyl, $C_{2-3}$ alkenyl, and H;

each R is independently selected from the group consisting of $C_{1-3}$ alkyl, $C_{2-3}$ alkenyl, and H;

each R' is independently selected from the group consisting of $C_{1-18}$ alkyl, $C_{2-18}$ alkenyl, —R*YR", —YR", and H;

each R" is independently selected from the group consisting of $C_{3-14}$ alkyl and $C_{3-14}$ alkenyl;

each R* is independently selected from the group consisting of $C_{1-12}$ alkyl and $C_{1-12}$ alkenyl;

each Y is independently a $C_{3-6}$ carbocycle;

each X is independently selected from the group consisting of F, Cl, Br, and I; and m is selected from 5, 6, 7, 8, 9, 10, 11, 12, and 13, or salts or stereoisomers thereof.

In certain embodiments, a subset of compounds of Formula (I) includes those of Formula (IA):

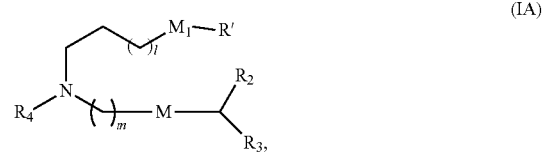

(IA)

or a salt or stereoisomer thereof, wherein l is selected from 1, 2, 3, 4, and 5; m is selected from 5, 6, 7, 8, and 9; $M_1$ is a bond or M'; $R_4$ is unsubstituted $C_{1-3}$ alkyl, or —(CH$_2$)$_n$Q, in which Q is OH, —NHC(S)N(R)$_2$, or —NHC(O)N(R)$_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In certain embodiments, a subset of compounds of Formula (I) includes those of Formula (II):

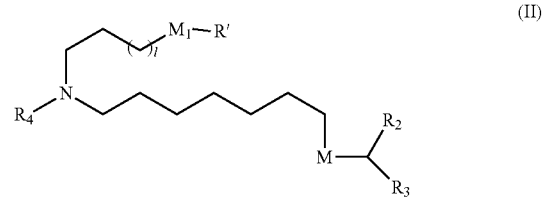

(II)

or a salt or stereoisomer thereof, wherein l is selected from 1, 2, 3, 4, and 5; $M_1$ is a bond or M'; $R_4$ is unsubstituted $C_{1-3}$ alkyl, or —(CH$_2$)$_n$Q, in which n is 2, 3, or 4, and Q is OH, —NHC(S)N(R)$_2$, or —NHC(O)N(R)$_2$; M and M' are independently selected from —C(O)O—, —OC(O)—, —C(O)N(R')—, —P(O)(OR')O—, an aryl group, and a heteroaryl group; and $R_2$ and $R_3$ are independently selected from the group consisting of H, $C_{1-14}$ alkyl, and $C_{2-14}$ alkenyl.

In some embodiments, the compound of formula (I) is of the formula (IIa),

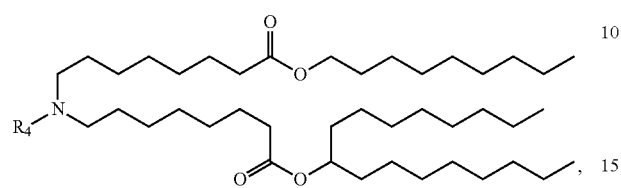

(IIa)

or a salt thereof, wherein $R_4$ is as described above.

In some embodiments, the compound of formula (I) is of the formula (IIb),

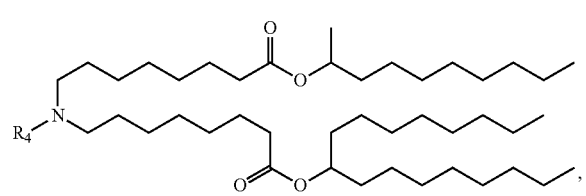

(IIb)

or a salt thereof, wherein $R_4$ is as described above.

In some embodiments, the compound of formula (I) is of the formula (IIc),

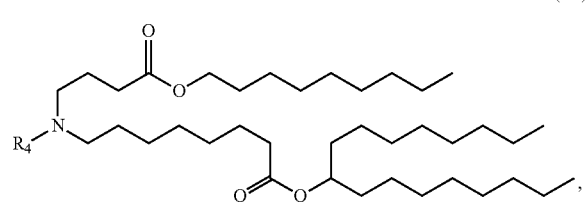

(IIc)

or a salt thereof, wherein $R_4$ is as described above.

In some embodiments, the compound of formula (I) is of the formula (IIe):

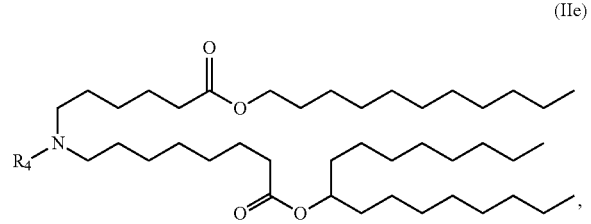

(IIe)

or a salt thereof, wherein $R_4$ is as described above.

In some embodiments, the compound of formula (IIa), (IIb), (IIc), or (IIe) comprises an $R_4$ which is selected from —(CH$_2$)$_n$Q and —(CH$_2$)$_n$CHQR, wherein Q, R and n are as defined above.

In some embodiments, Q is selected from the group consisting of —OR, —OH, —O(CH$_2$)$_n$N(R)$_2$, —OC(O)R, —CX$_3$, —CN, —N(R)C(O)R, —N(H)C(O)R, —N(R)S(O)$_2$R, —N(H)S(O)$_2$R, —N(R)C(O)N(R)$_2$, —N(H)C(O)N(R)$_2$, —N(H)C(O)N(H)(R), —N(R)C(S)N(R)$_2$, —N(H)C(S)N(R)$_2$, —N(H)C(S)N(H)(R), and a heterocycle, wherein R is as defined above. In some aspects, n is 1 or 2. In some embodiments, Q is OH, —NHC(S)N(R)$_2$, or —NHC(O)N(R)$_2$.

In some embodiments, the compound of formula (I) is of the formula (IId),

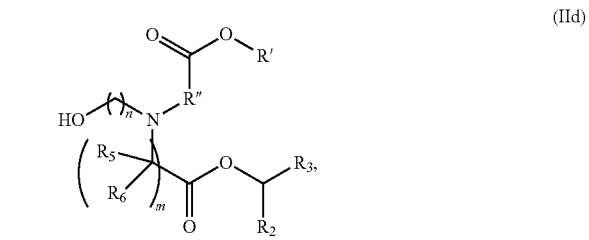

(IId)

or a salt thereof, wherein $R_2$ and $R_3$ are independently selected from the group consisting of $C_{5-14}$ alkyl and $C_{5-14}$ alkenyl, n is selected from 2, 3, and 4, and R', R", $R_5$, $R_6$ and m are as defined above.

In some aspects of the compound of formula (IId), $R_2$ is $C_8$ alkyl. In some aspects of the compound of formula (IId), $R_3$ is $C_5$-$C_9$ alkyl. In some aspects of the compound of formula (IId), m is 5, 7, or 9. In some aspects of the compound of formula (IId), each $R_5$ is H. In some aspects of the compound of formula (IId), each $R_6$ is H.

In another aspect, the present application provides a lipid composition (e.g., a lipid nanoparticle (LNP)) comprising: (1) a compound having the formula (I); (2) optionally a helper lipid (e.g. a phospholipid); (3) optionally a structural lipid (e.g. a sterol); (4) optionally a lipid conjugate (e.g. a PEG-lipid); and (5) optionally a quaternary amine compound. In exemplary embodiments, the lipid composition (e.g., LNP) further comprises a polynucleotide encoding an MCM polypeptide, e.g., a polynucleotide encapsulated therein.

As used herein, the term "alkyl" or "alkyl group" means a linear or branched, saturated hydrocarbon including one or more carbon atoms (e.g., one, two, three, four, five, six, seven, eight, nine, ten, eleven, twelve, thirteen, fourteen, fifteen, sixteen, seventeen, eighteen, nineteen, twenty, or more carbon atoms).

The notation "$C_{1-14}$ alkyl" means a linear or branched, saturated hydrocarbon including 1-14 carbon atoms. An alkyl group can be optionally substituted.

As used herein, the term "alkenyl" or "alkenyl group" means a linear or branched hydrocarbon including two or more carbon atoms (e.g., two, three, four, five, six, seven, eight, nine, ten, eleven, twelve, thirteen, fourteen, fifteen, sixteen, seventeen, eighteen, nineteen, twenty, or more carbon atoms) and at least one double bond.

The notation "$C_{2-14}$ alkenyl" means a linear or branched hydrocarbon including 2-14 carbon atoms and at least one double bond. An alkenyl group can include one, two, three, four, or more double bonds. For example, $C_{18}$ alkenyl can include one or more double bonds. A $C_{18}$ alkenyl group including two double bonds can be a linoleyl group. An alkenyl group can be optionally substituted.

As used herein, the term "carbocycle" or "carbocyclic group" means a mono- or multi-cyclic system including one or more rings of carbon atoms. Rings can be three, four, five, six, seven, eight, nine, ten, eleven, twelve, thirteen, fourteen, or fifteen membered rings.

The notation "$C_{3-6}$ carbocycle" means a carbocycle including a single ring having 3-6 carbon atoms. Carbocycles can include one or more double bonds and can be aromatic (e.g., aryl groups). Examples of carbocycles include cyclopropyl, cyclopentyl, cyclohexyl, phenyl, naphthyl, and 1,2-dihydronaphthyl groups. Carbocycles can be optionally substituted.

As used herein, the term "heterocycle" or "heterocyclic group" means a mono- or multi-cyclic system including one or more rings, where at least one ring includes at least one heteroatom. Heteroatoms can be, for example, nitrogen, oxygen, or sulfur atoms. Rings can be three, four, five, six, seven, eight, nine, ten, eleven, or twelve membered rings. Heterocycles can include one or more double bonds and can be aromatic (e.g., heteroaryl groups). Examples of heterocycles include imidazolyl, imidazolidinyl, oxazolyl, oxazolidinyl, thiazolyl, thiazolidinyl, pyrazolidinyl, pyrazolyl, isoxazolidinyl, isoxazolyl, isothiazolidinyl, isothiazolyl, morpholinyl, pyrrolyl, pyrrolidinyl, furyl, tetrahydrofuryl, thiophenyl, pyridinyl, piperidinyl, quinolyl, and isoquinolyl groups. Heterocycles can be optionally substituted.

As used herein, a "biodegradable group" is a group that can facilitate faster metabolism of a lipid in a subject. A biodegradable group can be, but is not limited to, —C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)$_2$—, an aryl group, and a heteroaryl group.

As used herein, an "aryl group" is a carbocyclic group including one or more aromatic rings. Examples of aryl groups include phenyl and naphthyl groups.

As used herein, a "heteroaryl group" is a heterocyclic group including one or more aromatic rings. Examples of heteroaryl groups include pyrrolyl, furyl, thiophenyl, imidazolyl, oxazolyl, and thiazolyl. Both aryl and heteroaryl groups can be optionally substituted. For example, M and M' can be selected from the non-limiting group consisting of optionally substituted phenyl, oxazole, and thiazole. In the formulas herein, M and M' can be independently selected from the list of biodegradable groups above.

Alkyl, alkenyl, and cyclyl (e.g., carbocyclyl and heterocyclyl) groups can be optionally substituted unless otherwise specified. Optional substituents can be selected from the group consisting of, but are not limited to, a halogen atom (e.g., a chloride, bromide, fluoride, or iodide group), a carboxylic acid (e.g., —C(O)OH), an alcohol (e.g., a hydroxyl, —OH), an ester (e.g., —C(O)OR or —OC(O)R), an aldehyde (e.g., —C(O)H), a carbonyl (e.g., —C(O)R, alternatively represented by C=O), an acyl halide (e.g., —C(O)X, in which X is a halide selected from bromide, fluoride, chloride, and iodide), a carbonate (e.g., —OC(O)OR), an alkoxy (e.g., —OR), an acetal (e.g., —C(OR)$_2$R'''', in which each OR are alkoxy groups that can be the same or different and R'''' is an alkyl or alkenyl group), a phosphate (e.g., P(O)$_4^{3-}$), a thiol (e.g., —SH), a sulfoxide (e.g., —S(O)R), a sulfinic acid (e.g., —S(O)OH), a sulfonic acid (e.g., —S(O)$_2$OH), a thial (e.g., —C(S)H), a sulfate (e.g., S(O)$_4^{2-}$), a sulfonyl (e.g., —S(O)$_2$—), an amide (e.g., —C(O)NR$_2$, or —N(R)C(O)R), an azido (e.g., —N$_3$), a nitro (e.g., —NO$_2$), a cyano (e.g., —CN), an isocyano (e.g., —NC), an acyloxy (e.g., —OC(O)R), an amino (e.g., —NR$_2$, —NRH, or —NH$_2$), a carbamoyl (e.g., —OC(O)NR$_2$, —OC(O)NRH, or —OC(O)NH$_2$), a sulfonamide (e.g., —S(O)$_2$NR$_2$, —S(O)$_2$NRH, —S(O)$_2$NH$_2$, —N(R)S(O)$_2$R, —N(H)S(O)$_2$R, —N(R)S(O)$_2$H, or —N(H)S(O)$_2$H), an alkyl group, an alkenyl group, and a cyclyl (e.g., carbocyclyl or heterocyclyl) group.

In any of the preceding, R is an alkyl or alkenyl group, as defined herein. In some embodiments, the substituent groups themselves can be further substituted with, for example, one, two, three, four, five, or six substituents as defined herein. For example, a $C_{1-6}$ alkyl group can be further substituted with one, two, three, four, five, or six substituents as described herein.

The compounds of any one of formulae (I), (IA), (II), (IIa), (IIb), (IIc), (IId), and (IIe) include one or more of the following features when applicable.

In some embodiments, $R_4$ is selected from the group consisting of a $C_{3-6}$ carbocycle, —(CH$_2$)$_n$Q, —(CH$_2$)$_n$CHQR, —CHQR, and —CQ(R)$_2$, where Q is selected from a $C_{3-6}$ carbocycle, 5- to 14-membered aromatic or non-aromatic heterocycle having one or more heteroatoms selected from N, O, S, and P, —OR, —O(CH$_2$)$_n$N(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)$_2$R, —N(R)C(O)N(R)$_2$, —N(R)C(S)N(R)$_2$, and —C(R)N(R)$_2$C(O)OR, and each n is independently selected from 1, 2, 3, 4, and 5.

In another embodiment, $R_4$ is selected from the group consisting of a $C_{3-6}$ carbocycle, —(CH$_2$)$_n$Q, —(CH$_2$)$_n$CHQR, —CHQR, and —CQ(R)$_2$, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —C(R)N(R)$_2$C(O)OR, and a 5- to 14-membered heterocycloalkyl having one or more heteroatoms selected from N, O, and S which is substituted with one or more substituents selected from oxo (=O), OH, amino, and $C_{1-3}$ alkyl, and each n is independently selected from 1, 2, 3, 4, and 5.

In another embodiment, $R_4$ is selected from the group consisting of a $C_{3-6}$ carbocycle, —(CH$_2$)$_n$Q, —(CH$_2$)$_n$CHQR, —CHQR, and —CQ(R)$_2$, where Q is selected from a $C_{3-6}$ carbocycle, a 5- to 14-membered heterocycle having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —C(R)N(R)$_2$C(O)OR, and each n is independently selected from 1, 2, 3, 4, and 5; and when Q is a 5- to 14-membered heterocycle and (i) $R_4$ is —(CH$_2$)$_n$Q in which n is 1 or 2, or (ii) $R_4$ is —(CH$_2$)$_n$CHQR in which n is 1, or (iii) $R_4$ is —CHQR, and —CQ(R)$_2$, then Q is either a 5- to 14-membered heteroaryl or 8- to 14-membered heterocycloalkyl.

In another embodiment, $R_4$ is selected from the group consisting of a $C_{3-6}$ carbocycle, —(CH$_2$)$_n$Q, —(CH$_2$)$_n$CHQR, —CHQR, and —CQ(R)$_2$, where Q is selected from a $C_{3-6}$ carbocycle, a 5- to 14-membered heteroaryl having one or more heteroatoms selected from N, O, and S, —OR, —O(CH$_2$)$_n$N(R)$_2$, —C(O)OR, —OC(O)R, —CX$_3$, —CX$_2$H, —CXH$_2$, —CN, —C(O)N(R)$_2$, —N(R)C(O)R, —N(R)S(O)$_2$R, —N(R)C(O)N(R)$_2$, —N(R)C(S)N(R)$_2$, —C(R)N(R)$_2$C(O)OR, and each n is independently selected from 1, 2, 3, 4, and 5.

In another embodiment, $R_4$ is unsubstituted $C_{1-4}$ alkyl, e.g., unsubstituted methyl.

In certain embodiments, the disclosure provides a compound having the Formula (I), wherein $R_4$ is —$(CH_2)_nQ$ or —$(CH_2)_nCHQR$, where Q is —$N(R)_2$, and n is selected from 3, 4, and 5.

In certain embodiments, the disclosure provides a compound having the Formula (I), wherein $R_4$ is selected from the group consisting of —$(CH_2)_nQ$, —$(CH_2)_nCHQR$, —CHQR, and —$CQ(R)_2$, where Q is —$N(R)_2$, and n is selected from 1, 2, 3, 4, and 5.

In certain embodiments, the disclosure provides a compound having the Formula (I), wherein $R_2$ and $R_3$ are independently selected from the group consisting of $C_{2-14}$ alkyl, $C_{2-14}$ alkenyl, —R*YR", —YR", and —R*OR", or $R_2$ and $R_3$, together with the atom to which they are attached, form a heterocycle or carbocycle, and $R_4$ is —$(CH_2)_nQ$ or —$(CH_2)_nCHQR$, where Q is —$N(R)_2$, and n is selected from 3, 4, and 5.

In certain embodiments, $R_2$ and $R_3$ are independently selected from the group consisting of $C_{2-14}$ alkyl, $C_{2-14}$ alkenyl, —R*YR", —YR", and —R*OR", or $R_2$ and $R_3$, together with the atom to which they are attached, form a heterocycle or carbocycle.

In some embodiments, $R_1$ is selected from the group consisting of $C_{5-20}$ alkyl and $C_{5-20}$ alkenyl.

In other embodiments, $R_1$ is selected from the group consisting of —R*YR", —YR", and —R"M'R'.

In certain embodiments, $R_1$ is selected from —R*YR" and —YR". In some embodiments, Y is a cyclopropyl group. In some embodiments, R* is $C_8$ alkyl or $C_8$ alkenyl. In certain embodiments, R" is $C_{3-12}$ alkyl. For example, R" can be $C_3$ alkyl. For example, R" can be $C_{4-8}$ alkyl (e.g., $C_4$, $C_5$, $C_6$, $C_7$, or $C_8$ alkyl).

In some embodiments, $R_1$ is $C_{5-20}$ alkyl. In some embodiments, $R_1$ is $C_6$ alkyl. In some embodiments, $R_1$ is $C_8$ alkyl. In other embodiments, $R_1$ is $C_9$ alkyl. In certain embodiments, $R_1$ is $C_{14}$ alkyl. In other embodiments, $R_1$ is Cis alkyl.

In some embodiments, $R_1$ is $C_{5-20}$ alkenyl. In certain embodiments, $R_1$ is $C_{18}$ alkenyl. In some embodiments, $R_1$ is linoleyl.

In certain embodiments, $R_1$ is branched (e.g., decan-2-yl, undecan-3-yl, dodecan-4-yl, tridecan-5-yl, tetradecan-6-yl, 2-methylundecan-3-yl, 2-methyldecan-2-yl, 3-methylundecan-3-yl, 4-methyldodecan-4-yl, or heptadeca-9-yl). In certain embodiments, $R_1$ is

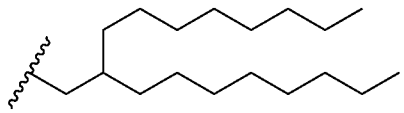

In certain embodiments, $R_1$ is unsubstituted $C_{5-20}$ alkyl or $C_{5-20}$ alkenyl. In certain embodiments, R' is substituted $C_{5-20}$ alkyl or $C_{5-20}$ alkenyl (e.g., substituted with a $C_{3-6}$ carbocycle such as 1-cyclopropylnonyl).

In other embodiments, $R_1$ is —R"M'R'.

In some embodiments, R' is selected from —R*YR" and —YR". In some embodiments, Y is $C_{3-8}$ cycloalkyl. In some embodiments, Y is $C_{6-10}$ aryl. In some embodiments, Y is a cyclopropyl group. In some embodiments, Y is a cyclohexyl group. In some embodiments, R* is $C_1$ alkyl.

In some embodiments, R" is selected from the group consisting of $C_{3-12}$ alkyl and $C_{3-12}$ alkenyl. In some embodiments, R" adjacent to Y is $C_1$ alkyl. In some embodiments, R" adjacent to Y is $C_{4-9}$ alkyl (e.g., $C_4$, $C_5$, $C_6$, $C_7$ or $C_8$ or $C_9$ alkyl).

In some embodiments, R' is selected from $C_4$ alkyl and $C_4$ alkenyl. In certain embodiments, R' is selected from $C_8$ alkyl and $C_8$ alkenyl. In some embodiments, R' is selected from $C_6$ alkyl and $C_6$ alkenyl. In some embodiments, R' is selected from $C_7$ alkyl and $C_7$ alkenyl. In some embodiments, R' is selected from $C_9$ alkyl and $C_9$ alkenyl.

In other embodiments, R' is selected from $C_{11}$ alkyl and $C_{11}$ alkenyl. In other embodiments, R' is selected from $C_{12}$ alkyl, $C_{12}$ alkenyl, $C_{13}$ alkyl, $C_{13}$ alkenyl, $C_{14}$ alkyl, $C_{14}$ alkenyl, $C_{15}$ alkyl, $C_{15}$ alkenyl, $C_{16}$ alkyl, $C_{16}$ alkenyl, $C_{17}$ alkyl, $C_{17}$ alkenyl, $C_{18}$ alkyl, and $C_{18}$ alkenyl. In certain embodiments, R' is branched (e.g., decan-2-yl, undecan-3-yl, dodecan-4-yl, tridecan-5-yl, tetradecan-6-yl, 2-methylundecan-3-yl, 2-methyldecan-2-yl, 3-methylundecan-3-yl, 4-methyldodecan-4-yl or heptadeca-9-yl). In certain embodiments, R' is

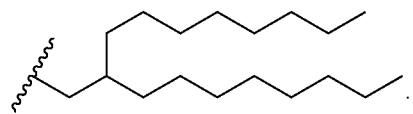 [SMILES: *CC(CCCCCCCC)CCCCCCCC]

In certain embodiments, R' is unsubstituted $C_{1-18}$ alkyl. In certain embodiments, R' is substituted $C_{1-18}$ alkyl (e.g., $C_{1-15}$ alkyl substituted with a $C_{3-6}$ carbocycle such as 1-cyclopropylnonyl).

In some embodiments, R" is selected from the group consisting of $C_{3-14}$ alkyl and $C_{3-14}$ alkenyl. In some embodiments, R" is $C_3$ alkyl, $C_4$ alkyl, $C_5$ alkyl, $C_6$ alkyl, $C_7$ alkyl, or $C_8$ alkyl. In some embodiments, R" is $C_9$ alkyl, $C_{10}$ alkyl, $C_{11}$ alkyl, $C_{12}$ alkyl, $C_{13}$ alkyl, or $C_{14}$ alkyl.

In some embodiments, M' is —C(O)O—. In some embodiments, M' is —OC(O)—.

In other embodiments, M' is an aryl group or heteroaryl group. For example, M' can be selected from the group consisting of phenyl, oxazole, and thiazole.

In some embodiments, M is —C(O)O— In some embodiments, M is —OC(O)—. In some embodiments, M is —C(O)N(R')—. In some embodiments, M is —P(O)(OR')O—.

In other embodiments, M is an aryl group or heteroaryl group. For example, M can be selected from the group consisting of phenyl, oxazole, and thiazole.

In some embodiments, M is the same as M'. In other embodiments, M is different from M'.

In some embodiments, each $R_5$ is H. In certain such embodiments, each $R_6$ is also H.

In some embodiments, $R_7$ is H. In other embodiments, $R_7$ is $C_{1-3}$ alkyl (e.g., methyl, ethyl, propyl, or i-propyl).

In some embodiments, $R_2$ and $R_3$ are independently $C_{5-14}$ alkyl or $C_{5-14}$ alkenyl.

In some embodiments, $R_2$ and $R_3$ are the same. In some embodiments, $R_2$ and $R_3$ are $C_8$ alkyl. In certain embodiments, $R_2$ and $R_3$ are $C_2$ alkyl. In other embodiments, $R_2$ and $R_3$ are $C_3$ alkyl. In some embodiments, $R_2$ and $R_3$ are $C_4$ alkyl. In certain embodiments, $R_2$ and $R_3$ are $C_5$ alkyl. In other embodiments, $R_2$ and $R_3$ are $C_6$ alkyl. In some embodiments, $R_2$ and $R_3$ are $C_7$ alkyl.

In other embodiments, $R_2$ and $R_3$ are different. In certain embodiments, $R_2$ is $C_8$ alkyl. In some embodiments, $R_3$ is $C_{1-7}$ (e.g., $C_1$, $C_2$, $C_3$, $C_4$, $C_5$, $C_6$, or $C_7$ alkyl) or $C_9$ alkyl.

In some embodiments, $R_7$ and $R_3$ are H.

In certain embodiments, $R_2$ is H.

In some embodiments, m is 5, 7, or 9.

In some embodiments, R$_4$ is selected from —(CH$_2$)$_n$Q and —(CH$_2$)$_n$CHQR.

In some embodiments, Q is selected from the group consisting of —OR, —OH, —O(CH$_2$)$_n$N(R)$_2$, —OC(O)R, —CX$_3$, —CN, —N(R)C(O)R, —N(H)C(O)R, —N(R)S(O)$_2$R, —N(H)S(O)$_2$R, —N(R)C(O)N(R)$_2$, —N(H)C(O)N(R)$_2$, —N(H)C(O)N(H)(R), —N(R)C(S)N(R)$_2$, —N(H)C(S)N(R)$_2$, —N(H)C(S)N(H)(R), —C(R)N(R)$_2$C(O)OR, a carbocycle, and a heterocycle.

In certain embodiments, Q is —OH.

In certain embodiments, Q is a substituted or unsubstituted 5- to 10-membered heteroaryl, e.g., Q is an imidazole, a pyrimidine, a purine, 2-amino-1,9-dihydro-6H-purin-6-one-9-yl (or guanin-9-yl), adenin-9-yl, cytosin-1-yl, or uracil-1-yl. In certain embodiments, Q is a substituted 5- to 14-membered heterocycloalkyl, e.g., substituted with one or more substituents selected from oxo (=O), OH, amino, and C$_{1-3}$ alkyl. For example, Q is 4-methylpiperazinyl, 4-(4-methoxybenzyl)piperazinyl, or isoindolin-2-yl-1,3-dione.

In certain embodiments, Q is an unsubstituted or substituted C$_{6-10}$ aryl (such as phenyl) or C$_{3-6}$ cycloalkyl.

In some embodiments, n is 1. In other embodiments, n is 2. In further embodiments, n is 3. In certain other embodiments, n is 4. For example, R$_4$ can be —(CH$_2$)$_2$OH. For example, R$_4$ can be —(CH$_2$)$_3$OH. For example, R$_4$ can be —(CH$_2$)$_4$OH. For example, R$_4$ can be benzyl. For example, R$_4$ can be 4-methoxybenzyl.

In some embodiments, R$_4$ is a C$_{3-6}$ carbocycle. In some embodiments, R$_4$ is a C$_{3-6}$ cycloalkyl. For example, R$_4$ can be cyclohexyl optionally substituted with e.g., OH, halo, C$_{1-6}$ alkyl, etc. For example, R$_4$ can be 2-hydroxycyclohexyl.

In some embodiments, R is H.

In some embodiments, R is unsubstituted C$_{1-3}$ alkyl or unsubstituted C$_{2-3}$ alkenyl. For example, R$_4$ can be —CH$_2$CH(OH)CH$_3$ or —CH$_2$CH(OH)CH$_2$CH$_3$.

In some embodiments, R is substituted C$_{1-3}$ alkyl, e.g., CH$_2$OH. For example, R$_4$ can be —CH$_2$CH(OH)CH$_2$OH.

In some embodiments, R$_2$ and R$_3$, together with the atom to which they are attached, form a heterocycle or carbocycle. In some embodiments, R$_2$ and R$_3$, together with the atom to which they are attached, form a 5- to 14-membered aromatic or non-aromatic heterocycle having one or more heteroatoms selected from N, O, S, and P. In some embodiments, R$_2$ and R$_3$, together with the atom to which they are attached, form an optionally substituted C$_{3-20}$ carbocycle (e.g., C$_{3-18}$ carbocycle, C$_{3-15}$ carbocycle, C$_{3-12}$ carbocycle, or C$_{3-10}$ carbocycle), either aromatic or non-aromatic. In some embodiments, R$_2$ and R$_3$, together with the atom to which they are attached, form a C$_{3-6}$ carbocycle. In other embodiments, R$_2$ and R$_3$, together with the atom to which they are attached, form a C$_6$ carbocycle, such as a cyclohexyl or phenyl group. In certain embodiments, the heterocycle or C$_{3-6}$ carbocycle is substituted with one or more alkyl groups (e.g., at the same ring atom or at adjacent or non-adjacent ring atoms). For example, R$_2$ and R$_3$, together with the atom to which they are attached, can form a cyclohexyl or phenyl group bearing one or more C$_5$ alkyl substitutions. In certain embodiments, the heterocycle or C$_{3-6}$ carbocycle formed by R$_2$ and R$_3$, is substituted with a carbocycle groups. For example, R$_2$ and R$_3$, together with the atom to which they are attached, can form a cyclohexyl or phenyl group that is substituted with cyclohexyl. In some embodiments, R$_2$ and R$_3$, together with the atom to which they are attached, form a C$_{7-15}$ carbocycle, such as a cycloheptyl, cyclopentadecanyl, or naphthyl group.

In some embodiments, R$_4$ is selected from —(CH$_2$)$_n$Q and —(CH$_2$)$_n$CHQR. In some embodiments, Q is selected from the group consisting of —OR, —OH, —O(CH$_2$)$_n$N(R)$_2$, —OC(O)R, —CX$_3$, —CN, —N(R)C(O)R, —N(H)C(O)R, —N(R)S(O)$_2$R, —N(H)S(O)$_2$R, —N(R)C(O)N(R)$_2$, —N(H)C(O)N(R)$_2$, —N(H)C(O)N(H)(R), —N(R)C(S)N(R)$_2$, —N(H)C(S)N(R)$_2$, —N(H)C(S)N(H)(R), and a heterocycle. In other embodiments, Q is selected from the group consisting of an imidazole, a pyrimidine, and a purine.

In some embodiments, R$_2$ and R$_3$, together with the atom to which they are attached, form a heterocycle or carbocycle. In some embodiments, R$_2$ and R$_3$, together with the atom to which they are attached, form a C$_{3-6}$ carbocycle, such as a phenyl group. In certain embodiments, the heterocycle or C$_{3-6}$ carbocycle is substituted with one or more alkyl groups (e.g., at the same ring atom or at adjacent or non-adjacent ring atoms). For example, R$_2$ and R$_3$, together with the atom to which they are attached, can form a phenyl group bearing one or more C$_5$ alkyl substitutions.

In some embodiments, the pharmaceutical compositions of the present disclosure, the compound of formula (I) is selected from the group consisting of:

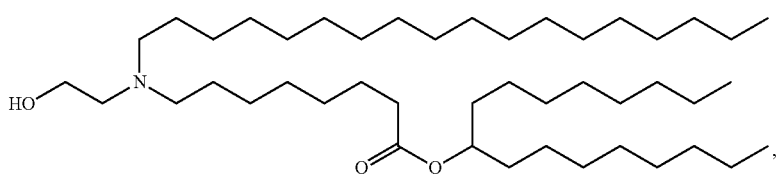

(Compound 1)

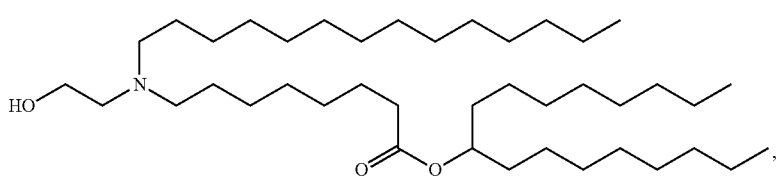

(Compound 2)

(Compound 3)
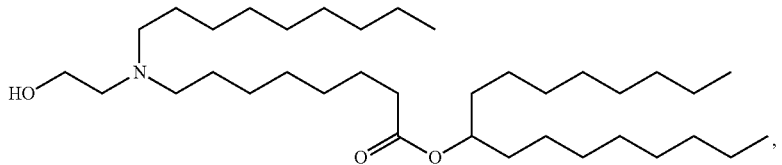
(Compound 4)
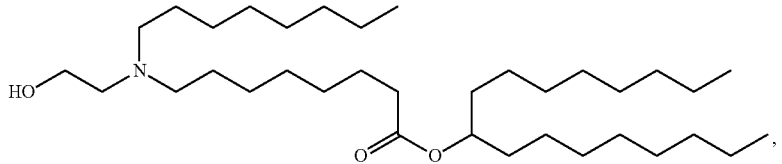
(Compound 5)
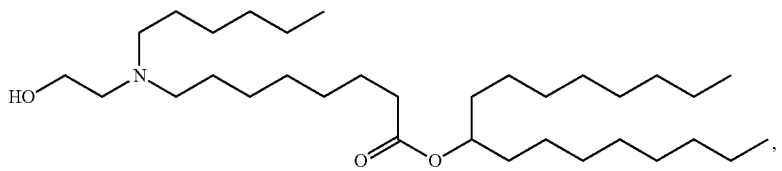
(Compound 6)
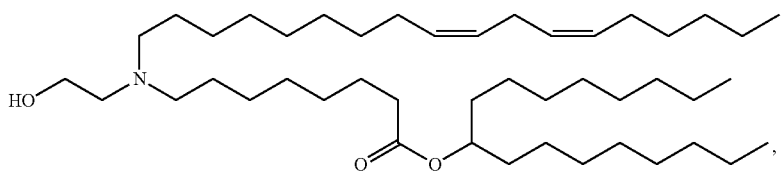
(Compound 7)
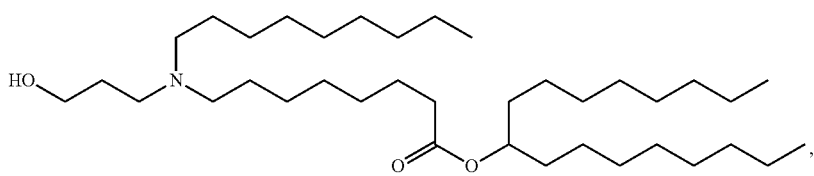
(Compound 8)
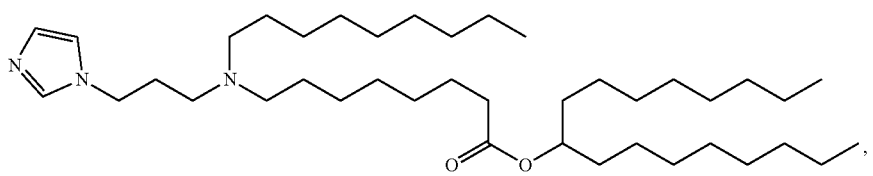
(Compound 9)
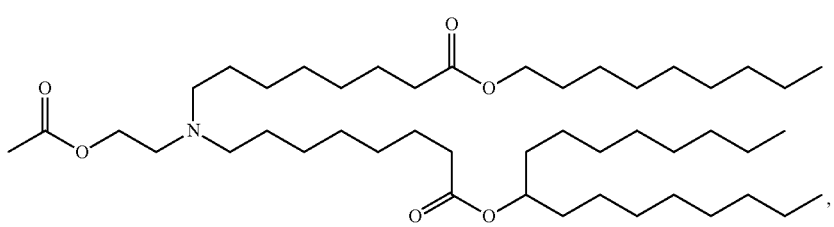
(Compound 10)
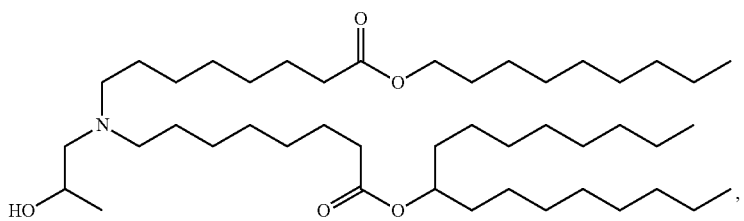

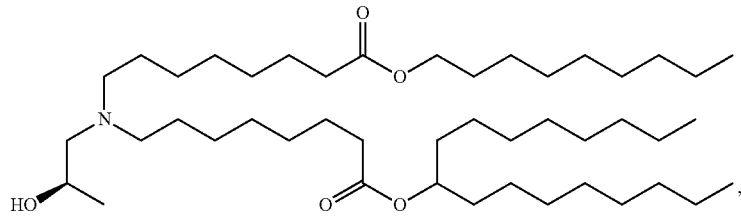
(Compound 11)
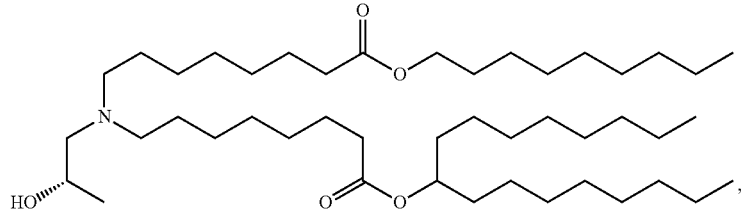
(Compound 12)
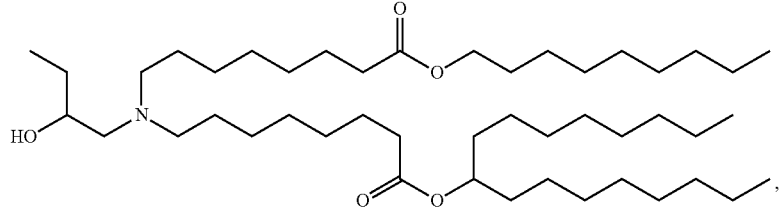
(Compound 13)
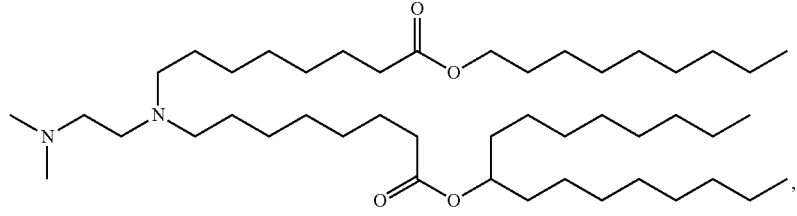
(Compound 14)
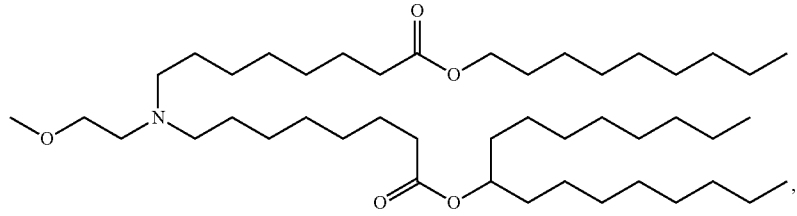
(Compound 15)
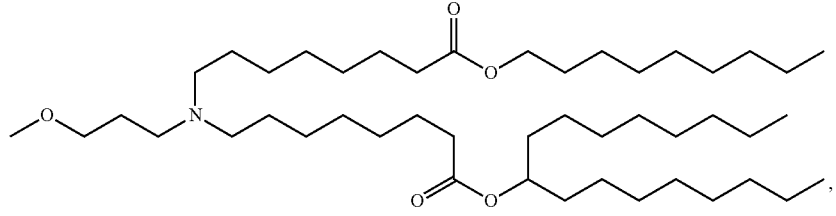
(Compound 16)
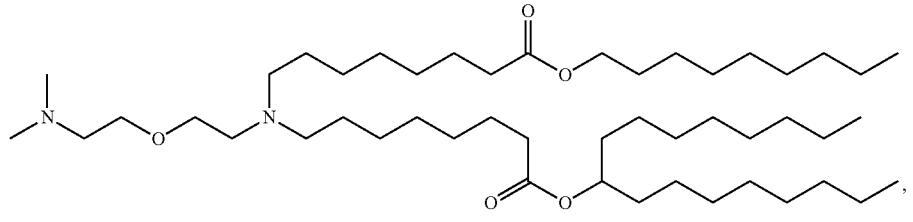
(Compound 17)

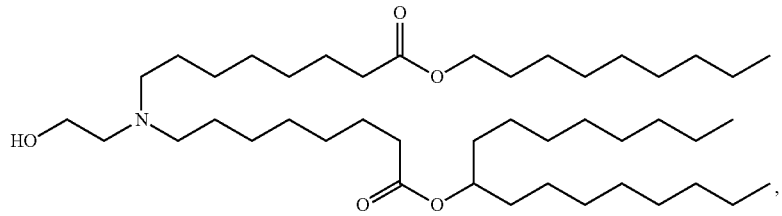
(Compound 18)
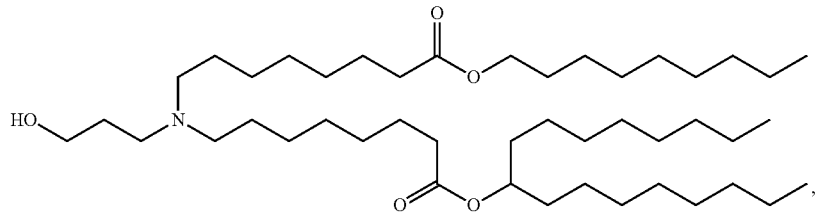
(Compound 19)
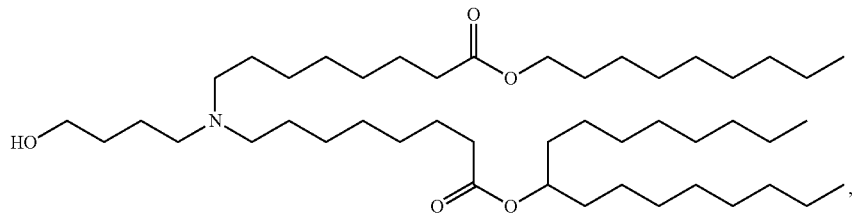
(Compound 20)
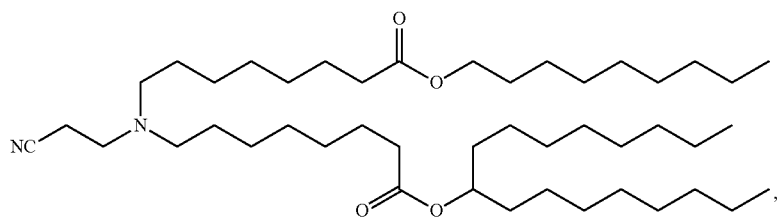
(Compound 21)
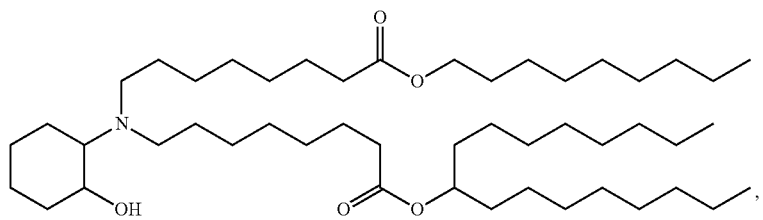
(Compound 22)
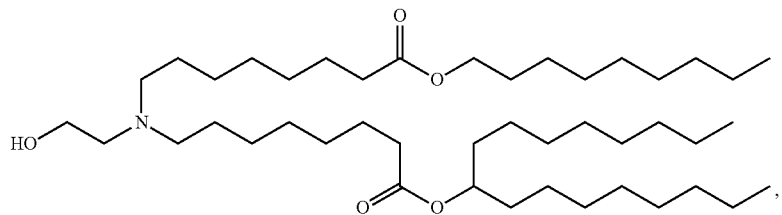
(Compound 23)
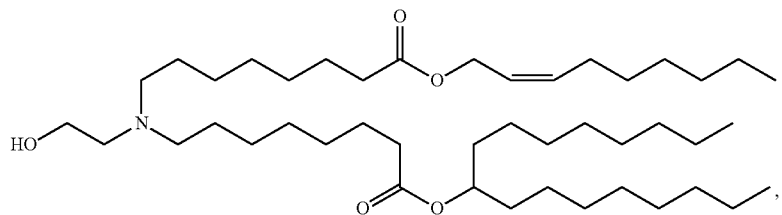
(Compound 24)

-continued
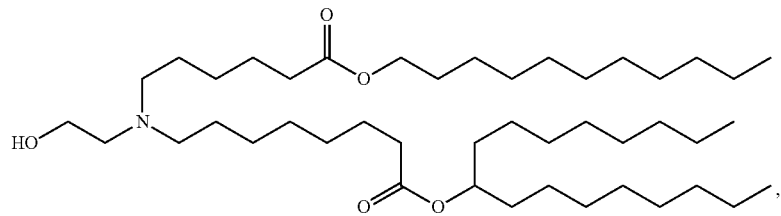
(Compound 25)
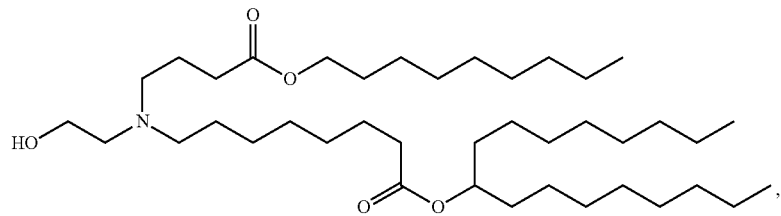
(Compound 26)
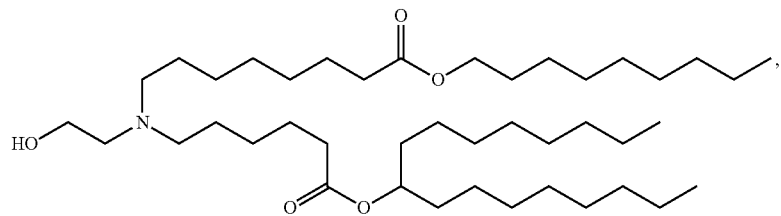
(Compound 27)
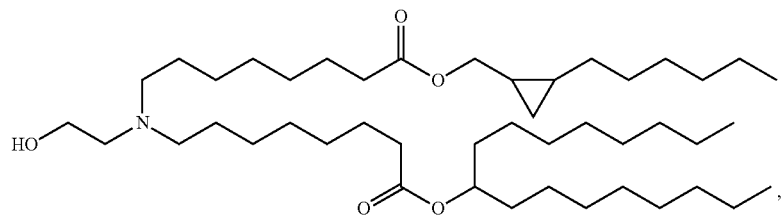
(Compound 28)
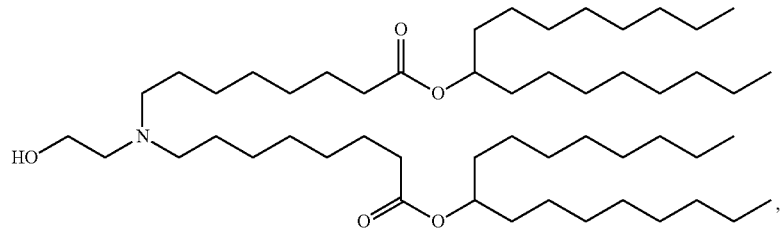
(Compound 29)
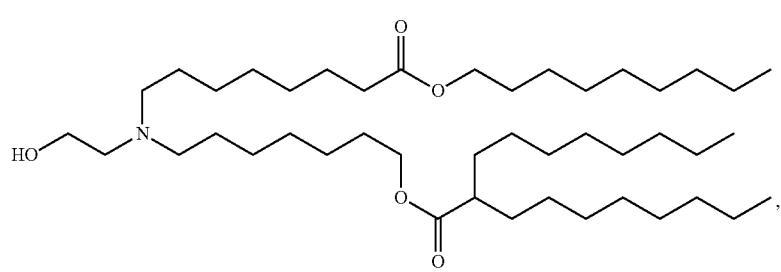
(Compound 30)
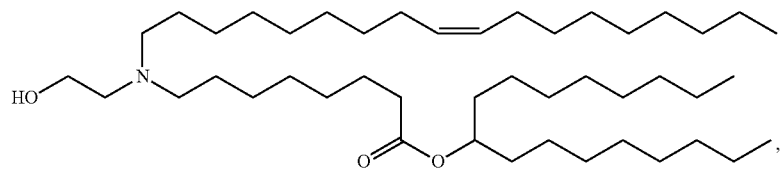
(Compound 31)

-continued
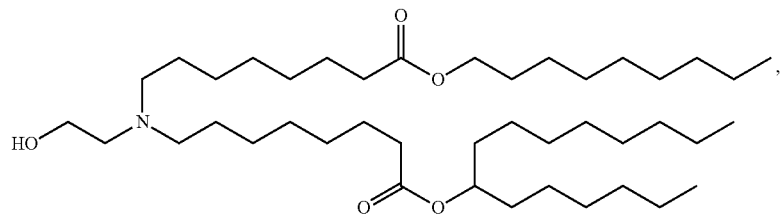
(Compound 32)
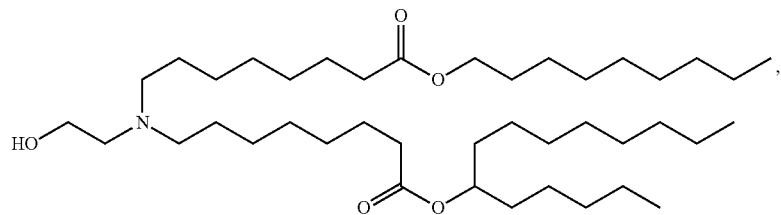
(Compound 33)
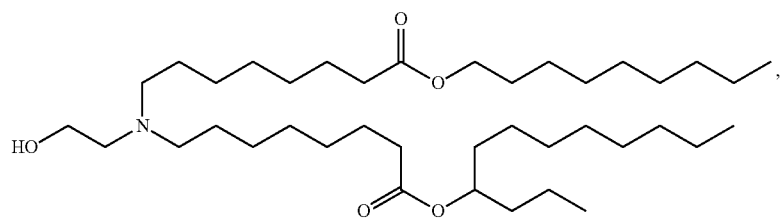
(Compound 34)
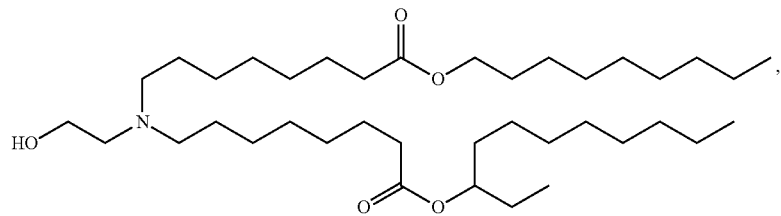
(Compound 35)
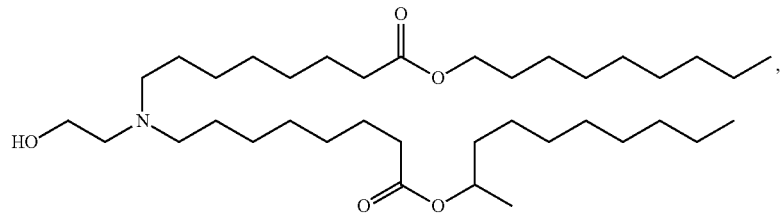
(Compound 36)
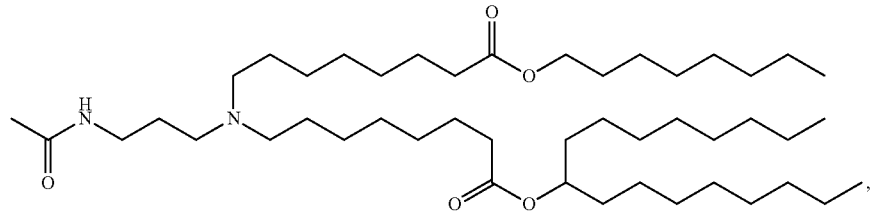
(Compound 37)
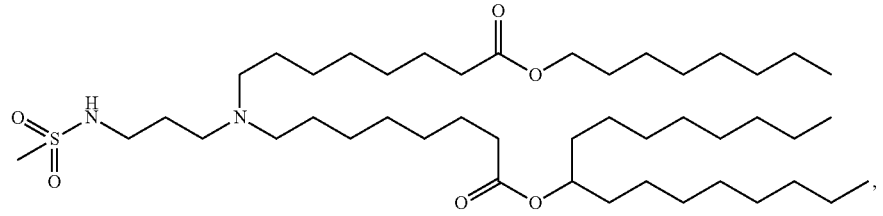
(Compound 38)

-continued
(Compound 39)
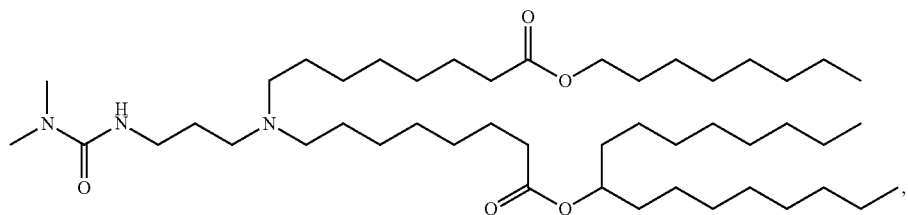
(Compound 40)
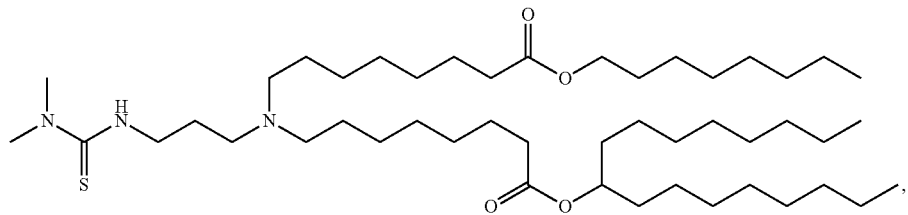
(Compound 41)
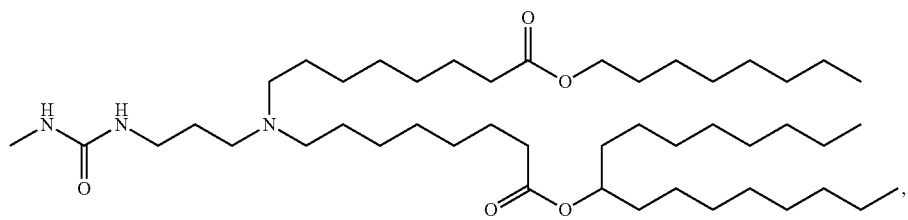
(Compound 42)
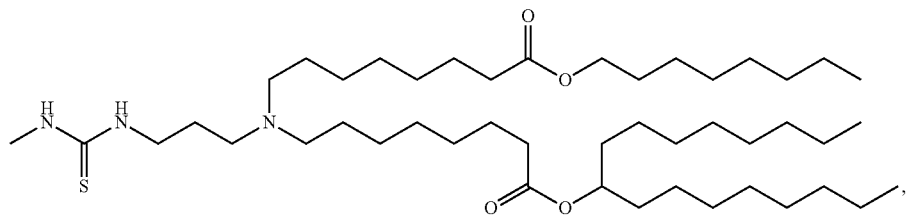
(Compound 43)
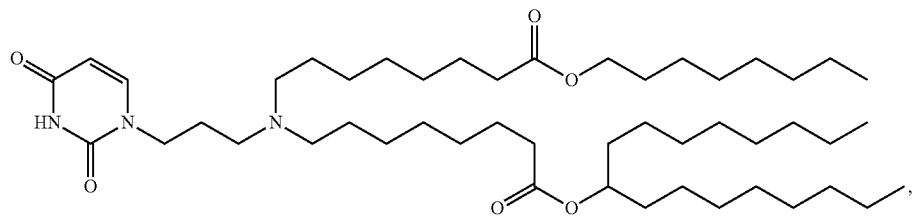
(Compound 44)
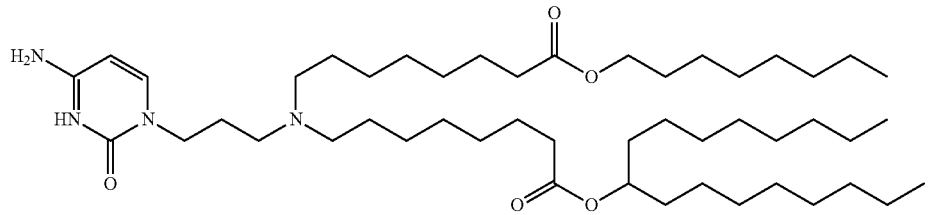
(Compound 45)
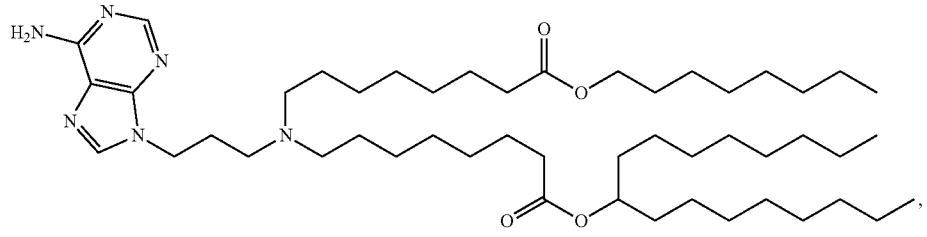

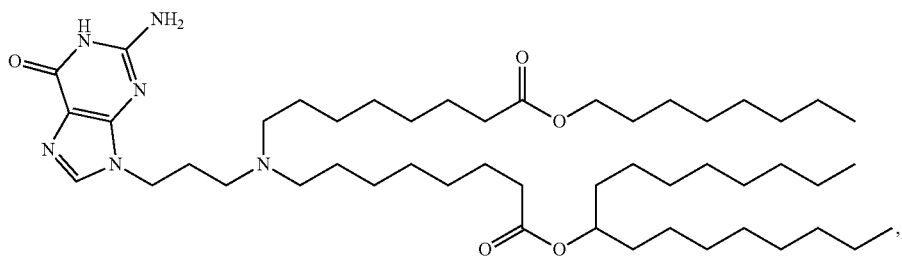
(Compound 46)
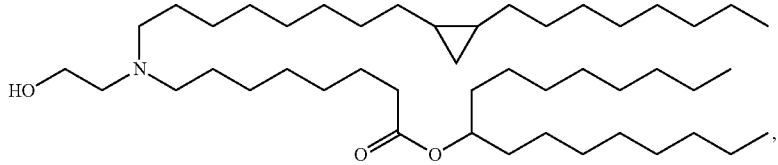
(Compound 47)
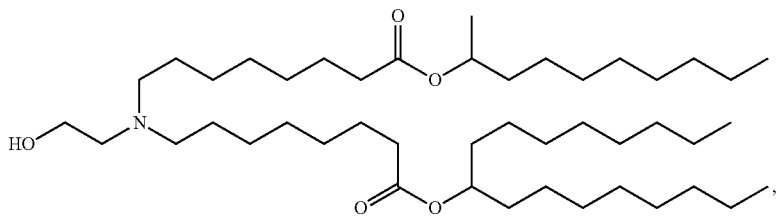
(Compound 48)
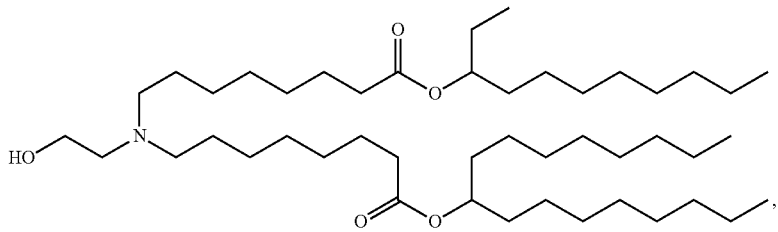
(Compound 49)
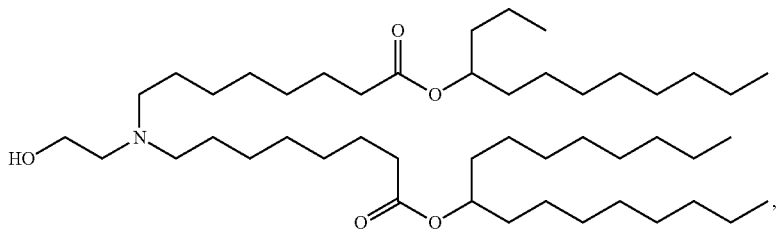
(Compound 50)
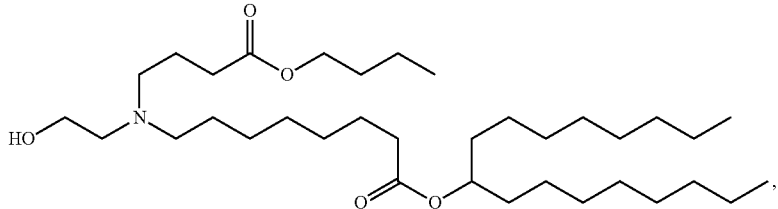
(Compound 51)
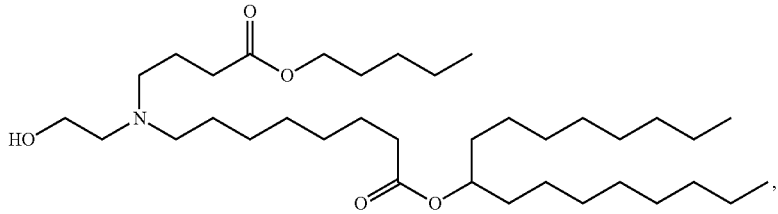
(Compound 52)

(Compound 53)
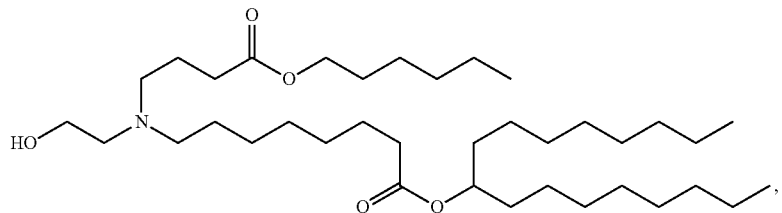
(Compound 54)
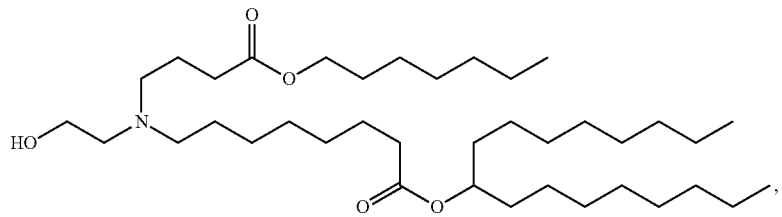
(Compound 55)
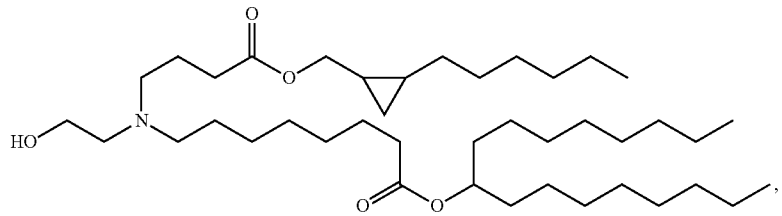
(Compound 56)
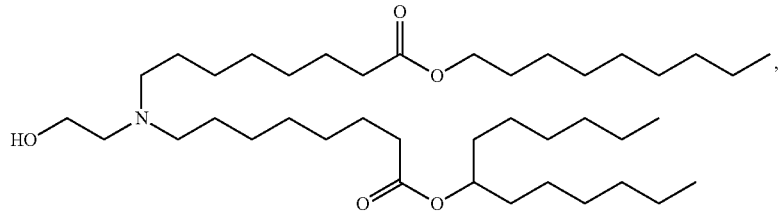
(Compound 57)
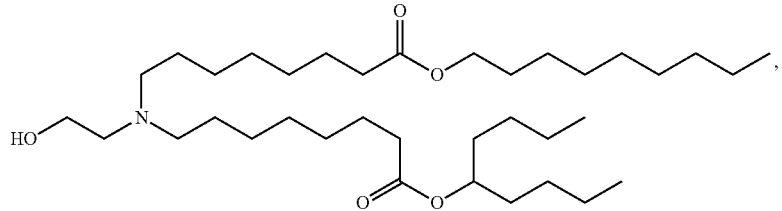
(Compound 58)
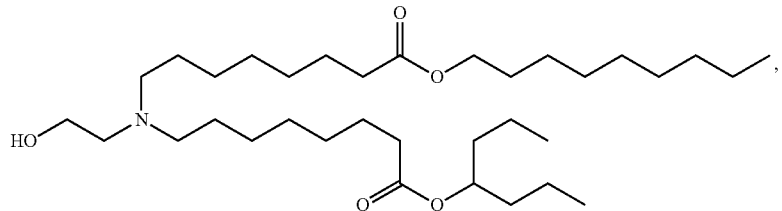
(Compound 59)
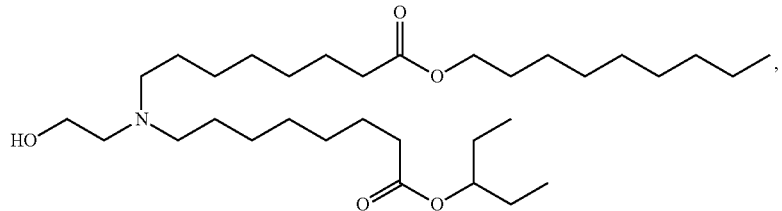

(Compound 60)
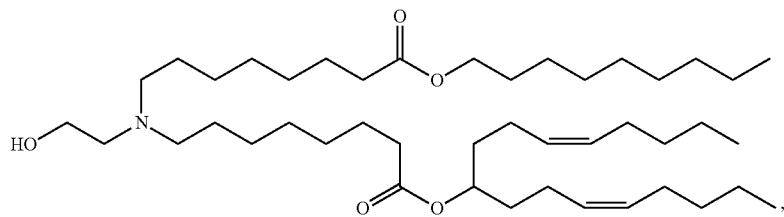
(Compound 61)
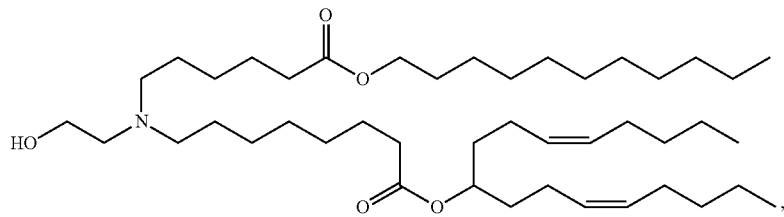
(Compound 62)
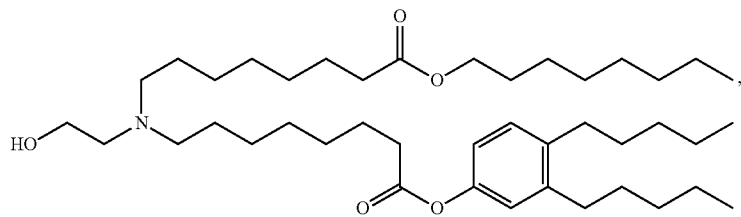
(Compound 63)
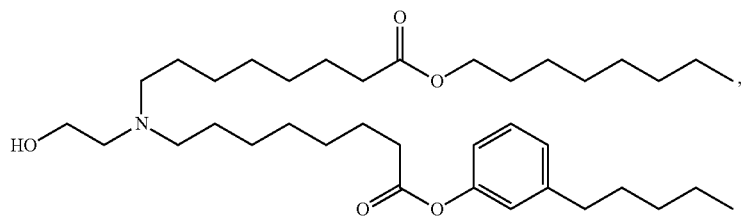
(Compound 64)
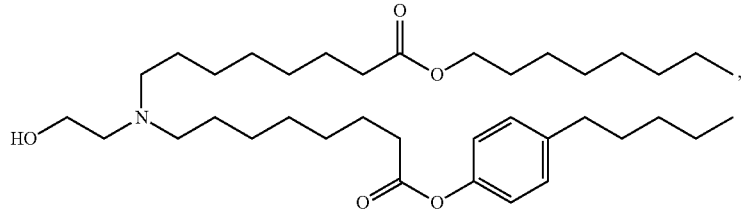
(Compound 65)
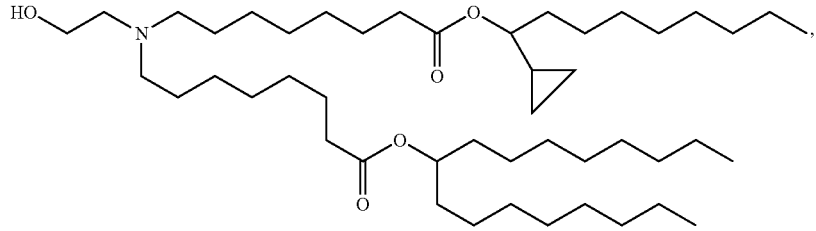
(Compound 66)
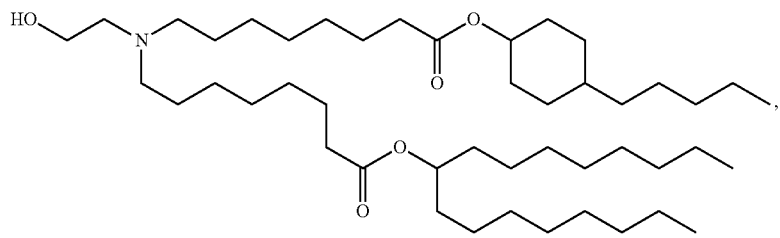

(Compound 67)
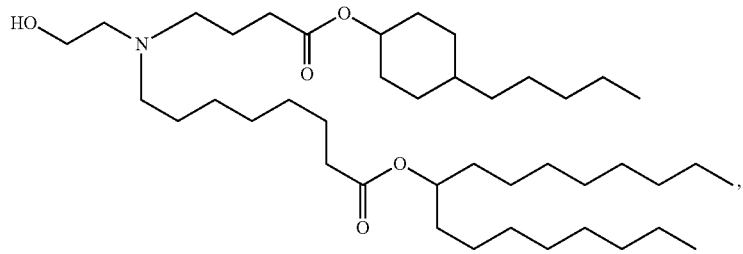
(Compound 68)
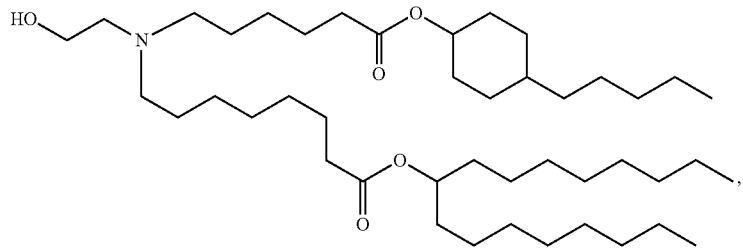
(Compound 69)
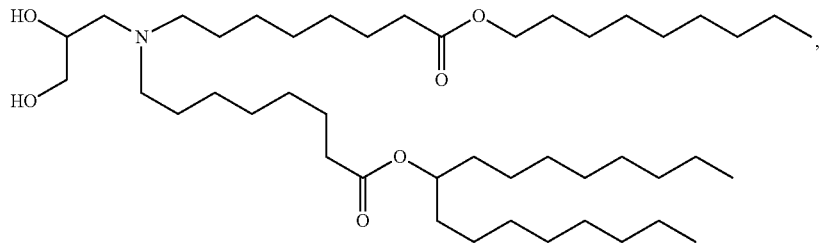
(Compound 70)
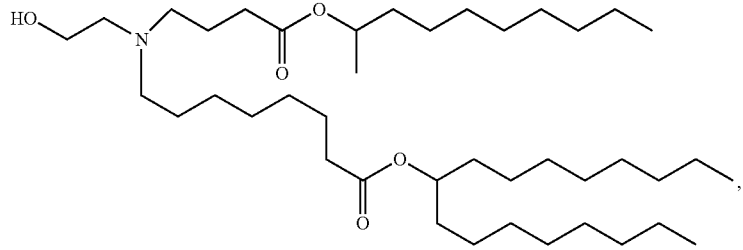
(Compound 71)
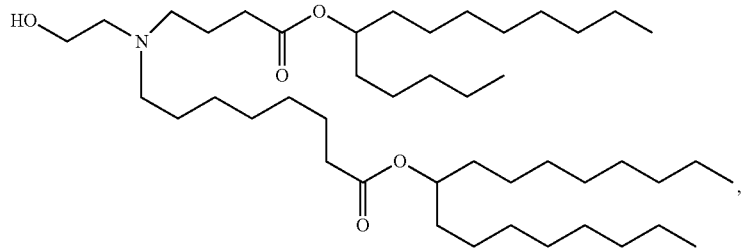
(Compound 72)
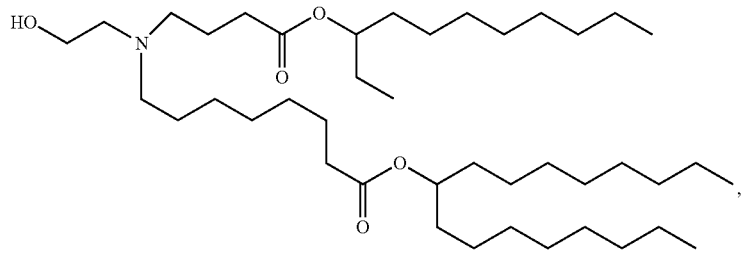

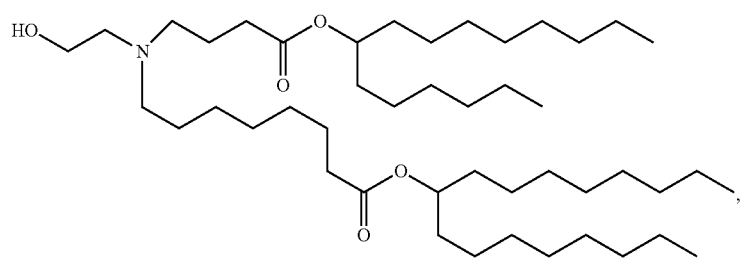
(Compound 73)
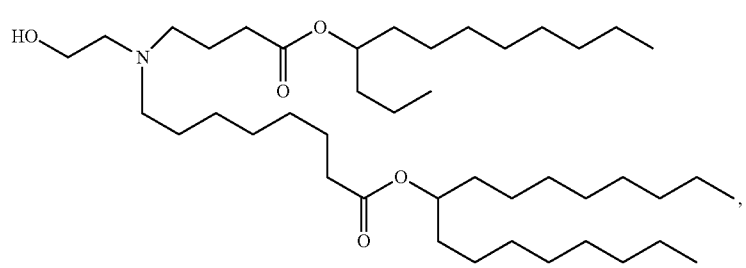
(Compound 74)
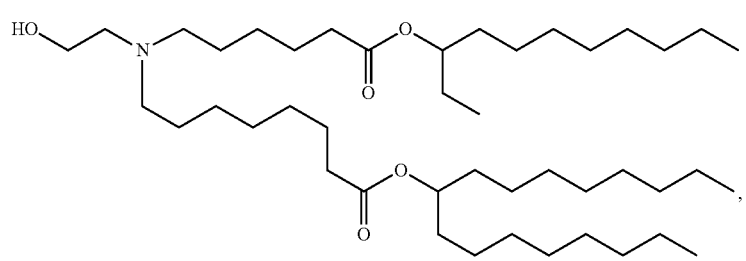
(Compound 75)
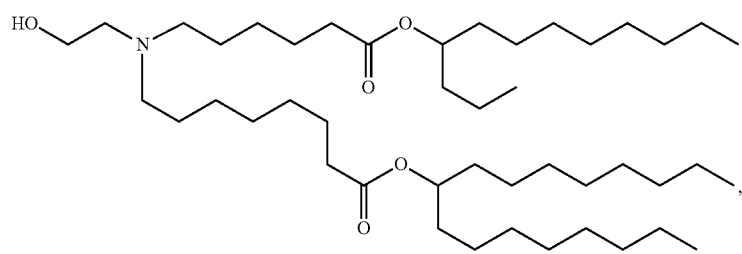
(Compound 76)
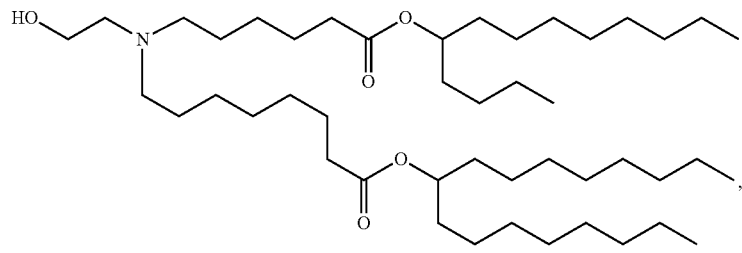
(Compound 77)
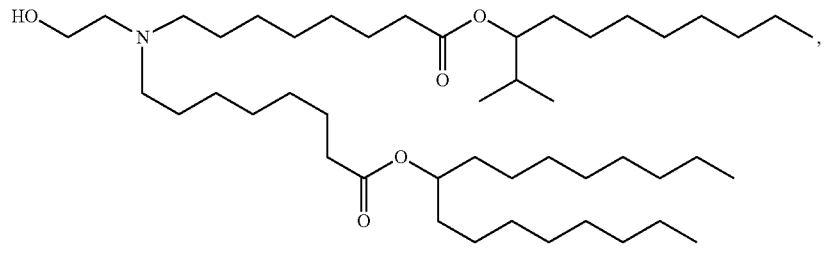
(Compound 78)

-continued
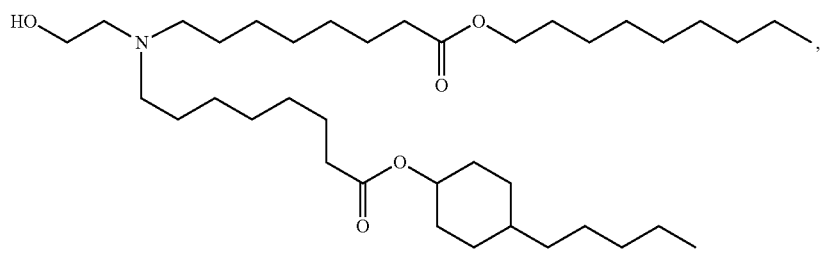
(Compound 79)
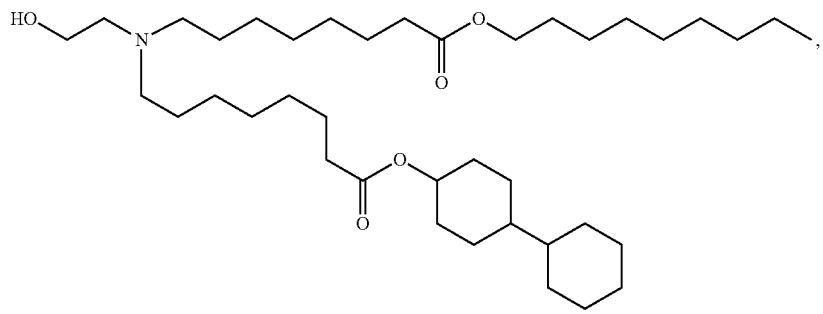
(Compound 80)
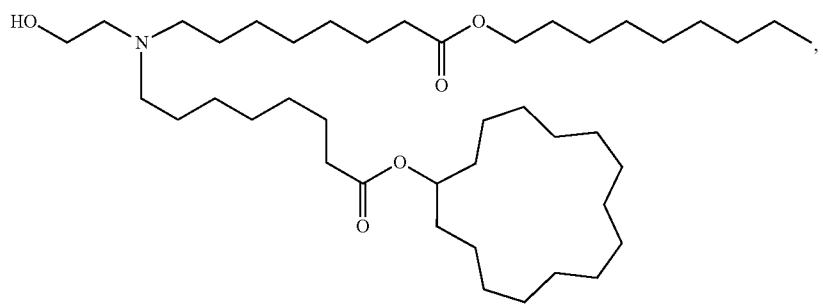
(Compound 81)
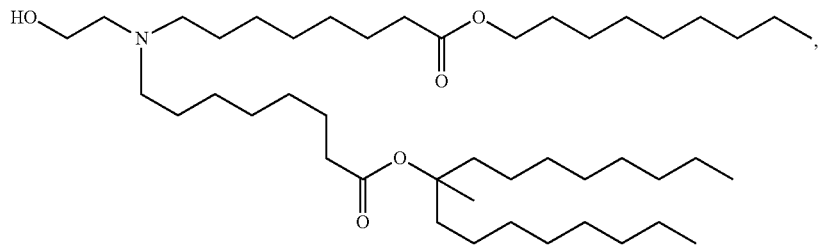
(Compound 82)
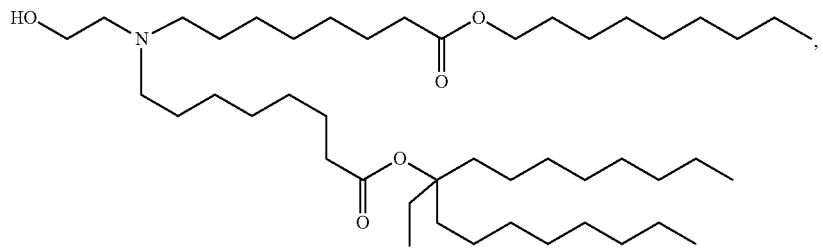
(Compound 83)
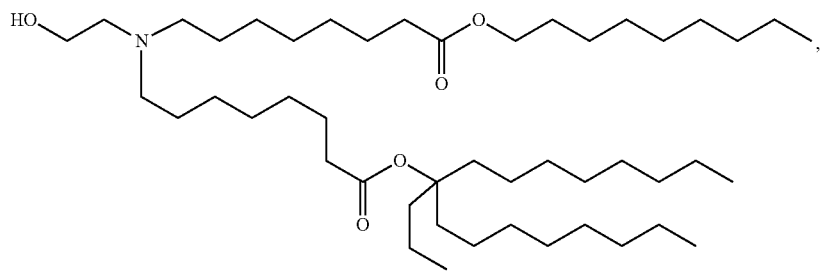
(Compound 84)

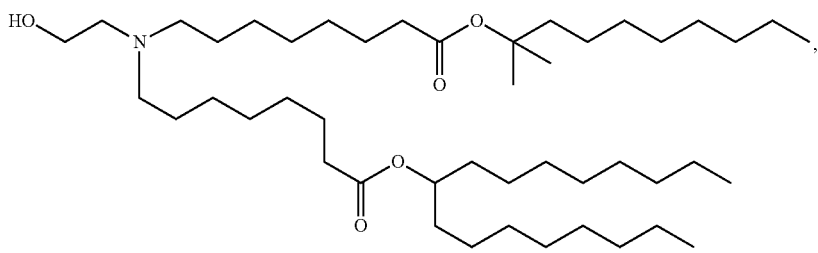
(Compound 85)
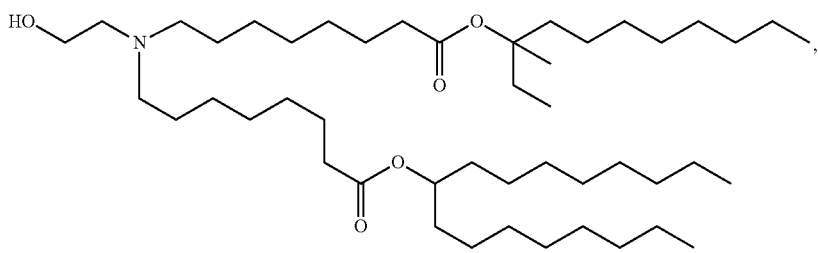
(Compound 86)
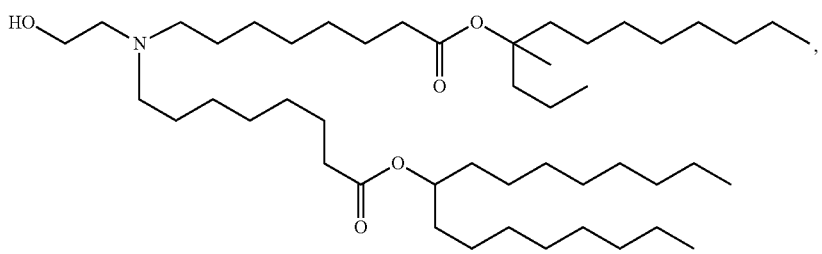
(Compound 87)
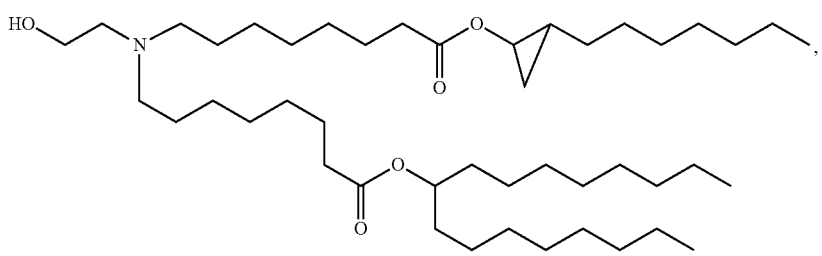
(Compound 88)
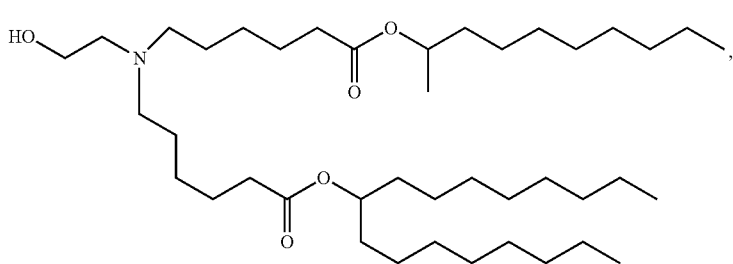
(Compound 89)
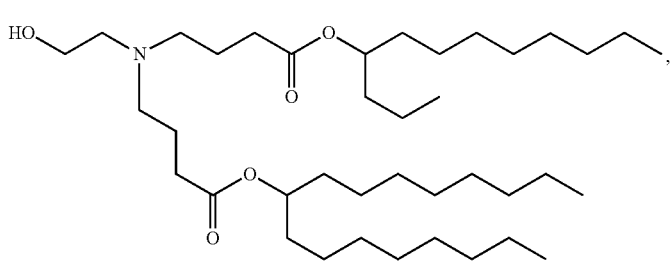
(Compound 90)

-continued
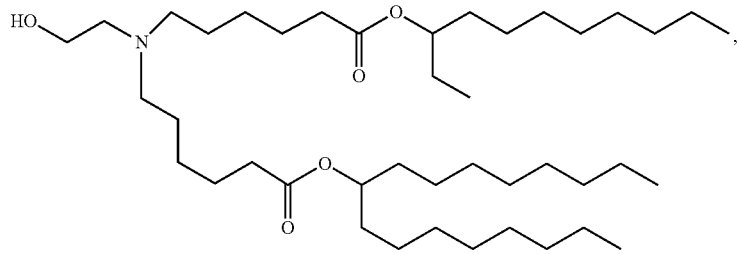
(Compound 91)
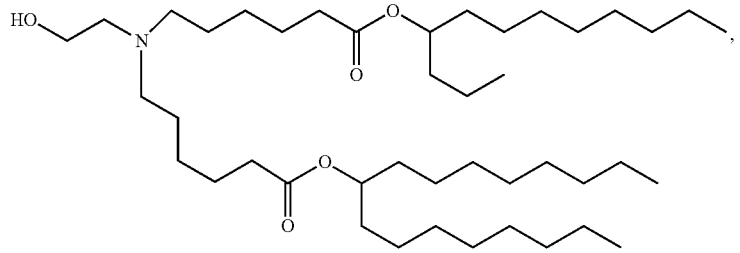
(Compound 92)
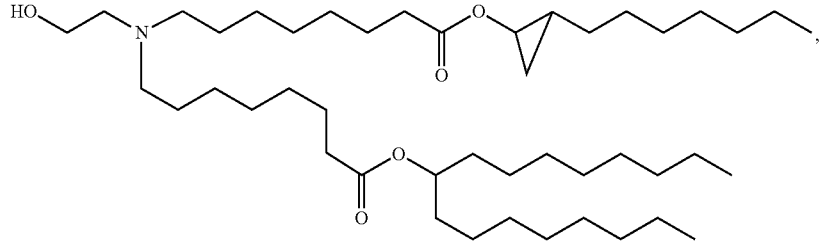
(Compound 93)
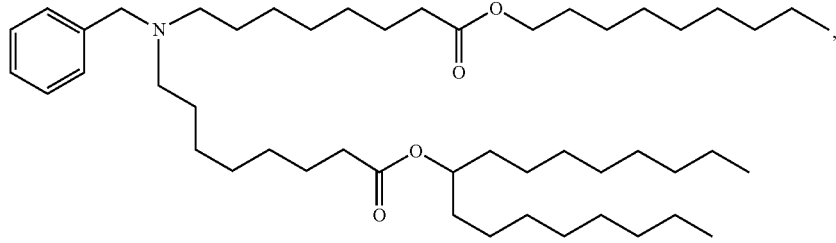
(Compound 94)
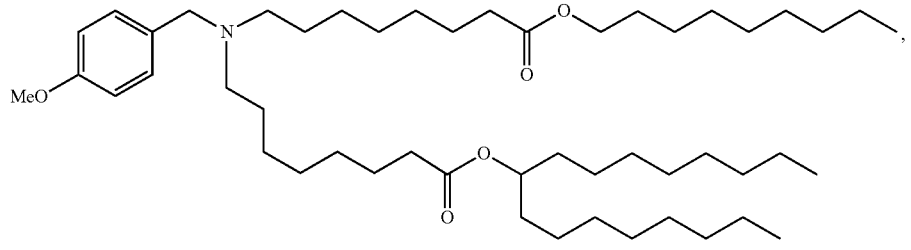
(Compound 95)
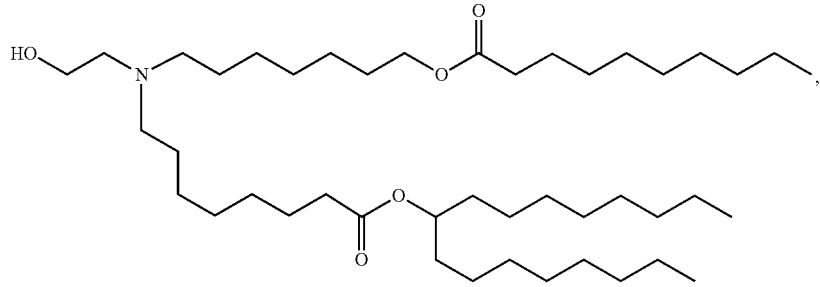
(Compound 96)

-continued
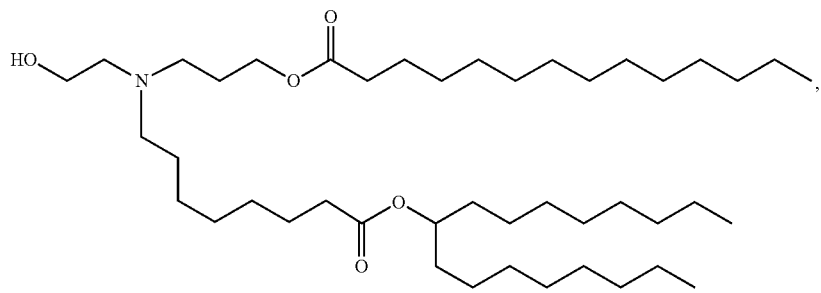
(Compound 97)
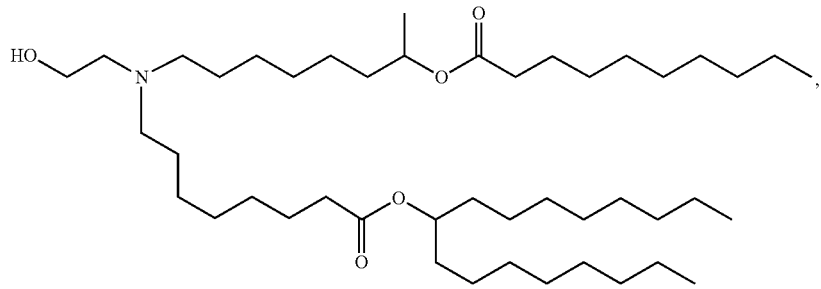
(Compound 98)
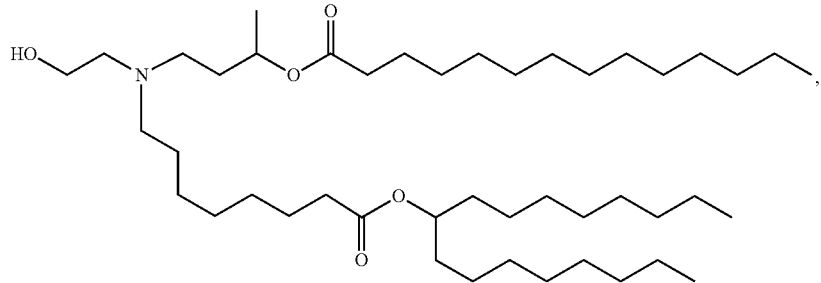
(Compound 99)
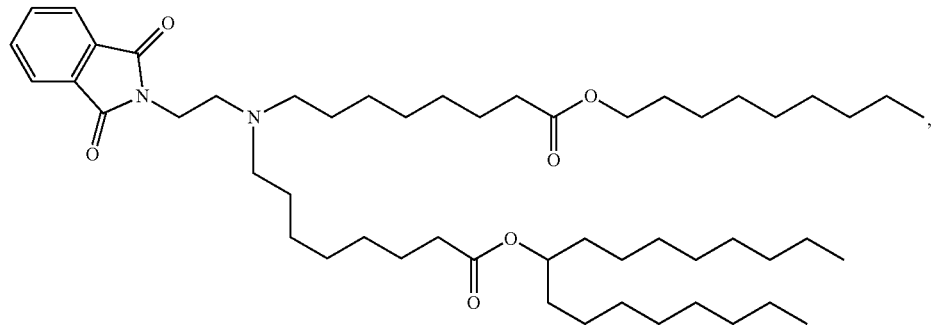
(Compound 100)
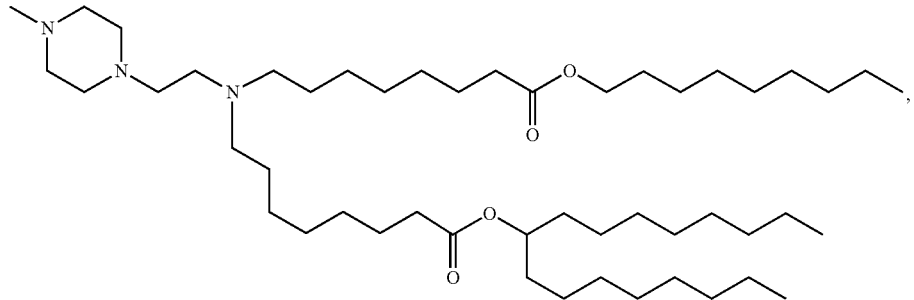
(Compound 101)

-continued
(Compound 102)
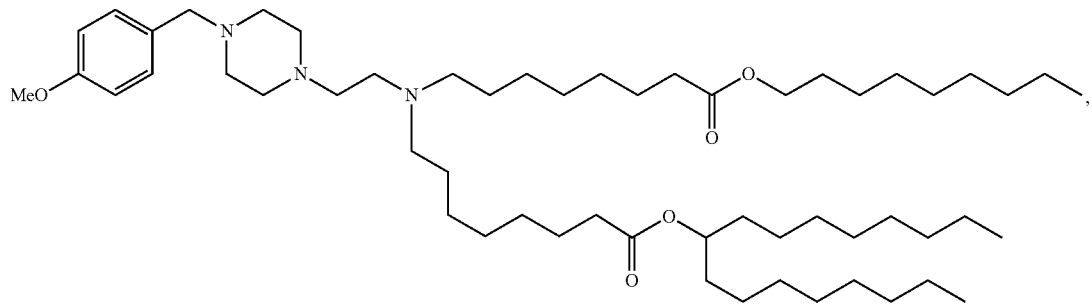
(Compound 103)
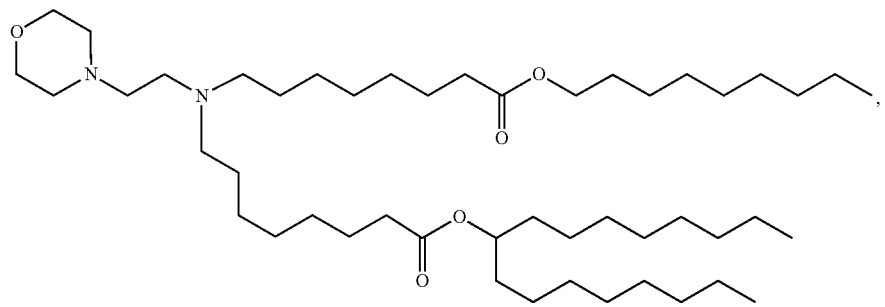
(Compound 104)
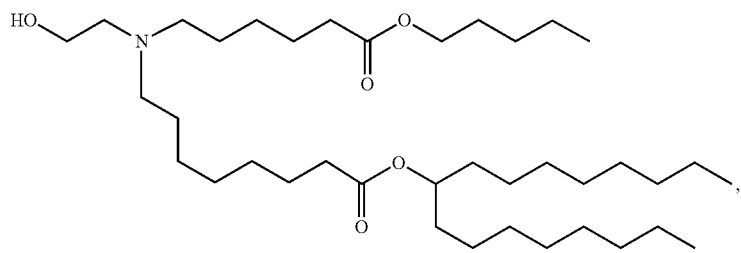
(Compound 105)
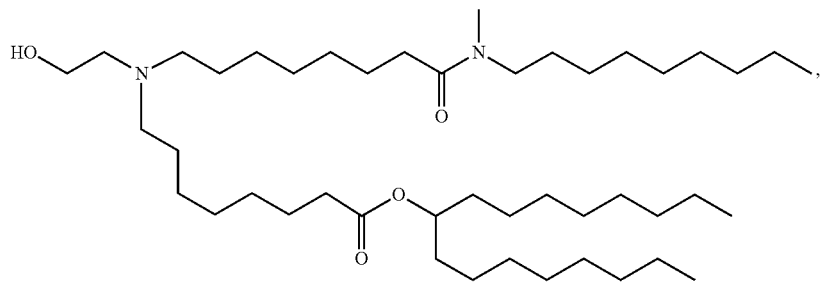
(Compound 106)
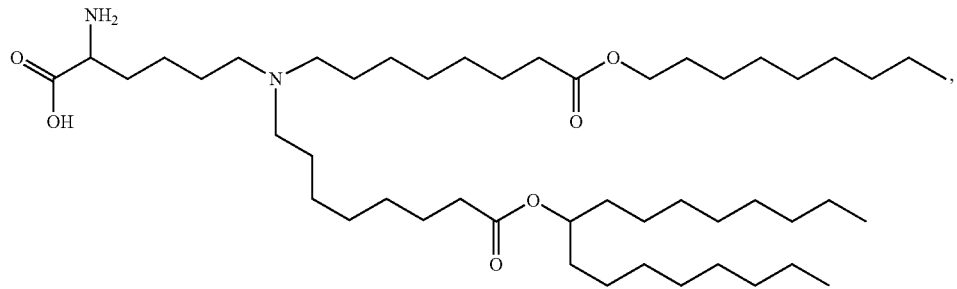

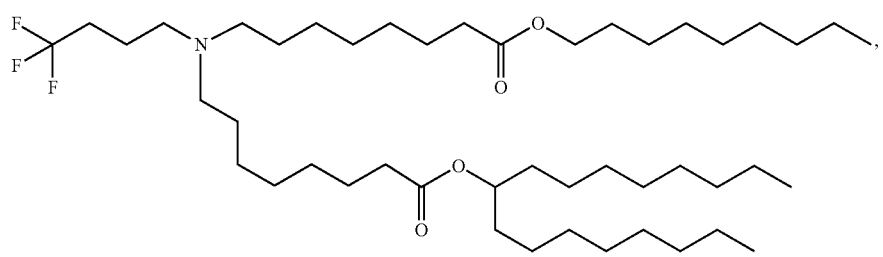
(Compound 107)
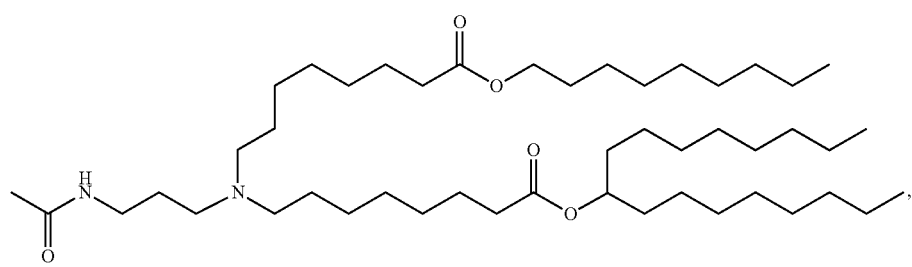
(Compound 108)
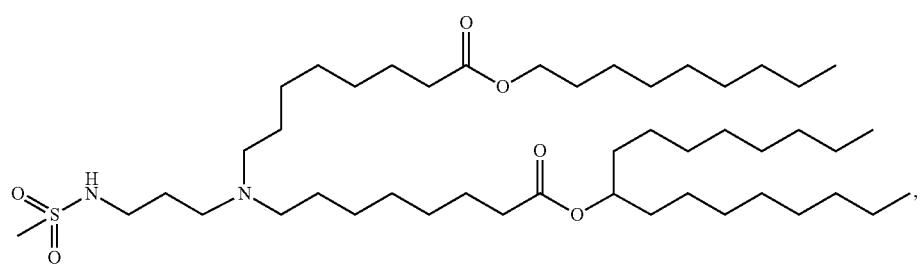
(Compound 109)
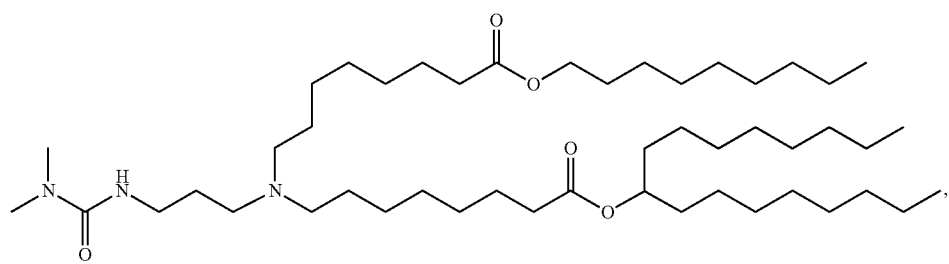
(Compound 110)
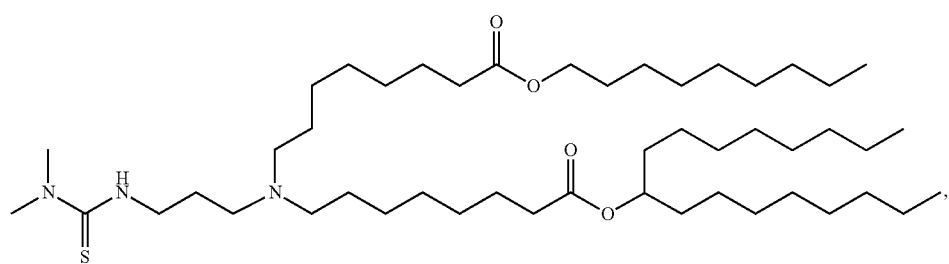
(Compound 111)
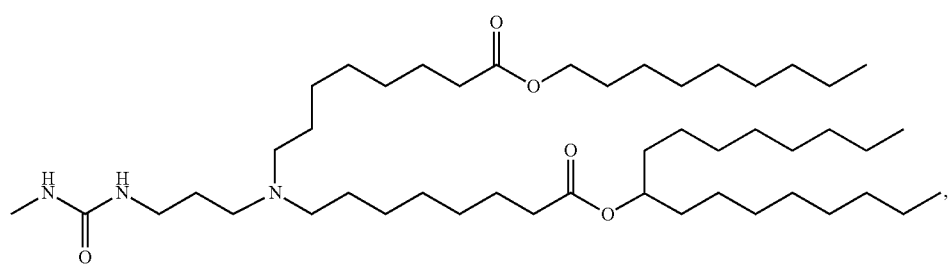
(Compound 112)

(Compound 113)
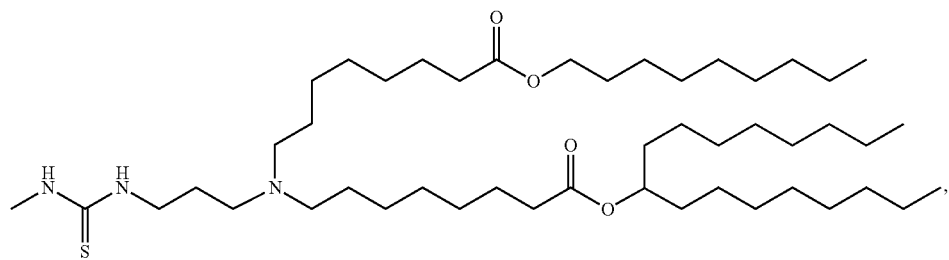
(Compound 114)
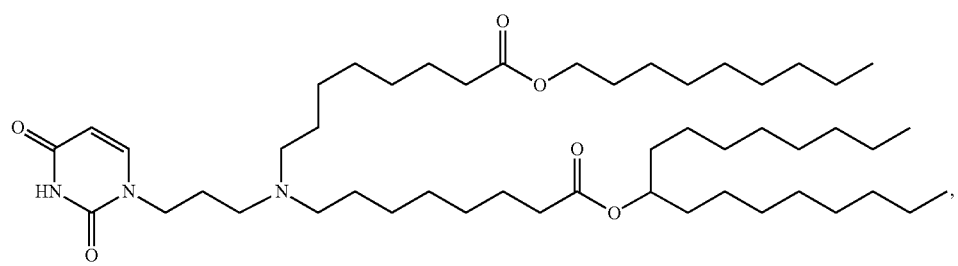
(Compound 115)
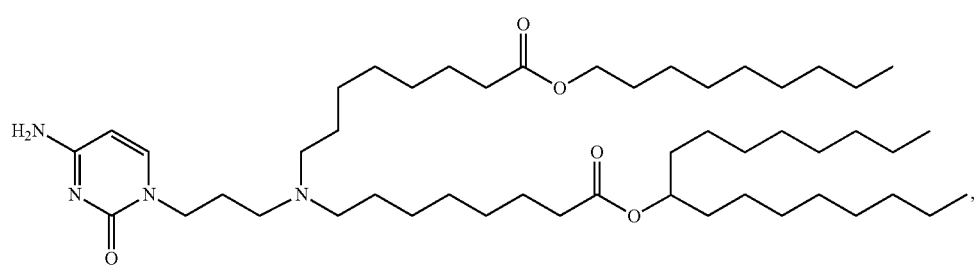
(Compound 116)
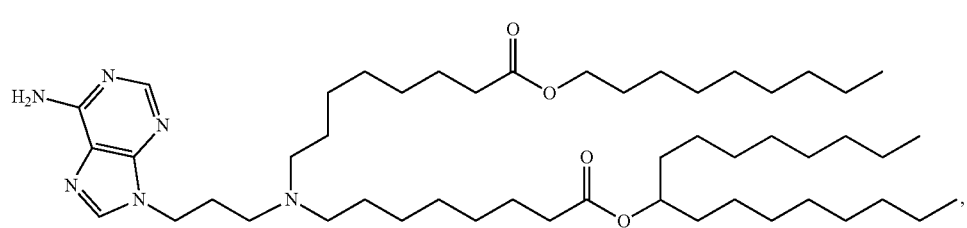
(Compound 117)
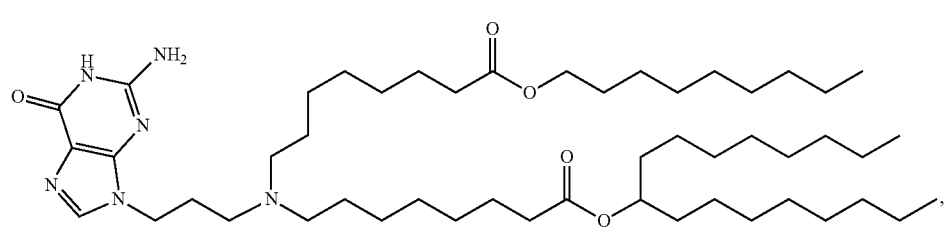
(Compound 118)
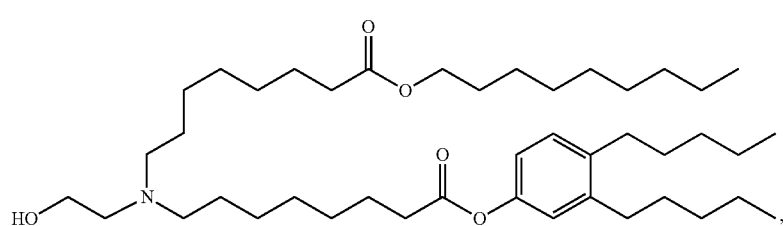

-continued
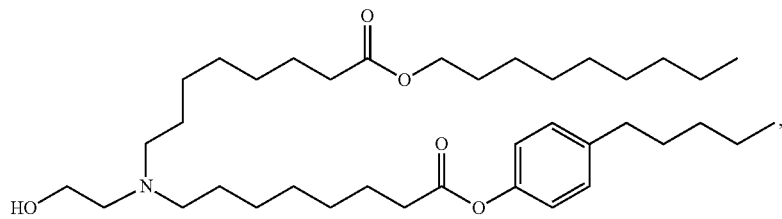
(Compound 119)
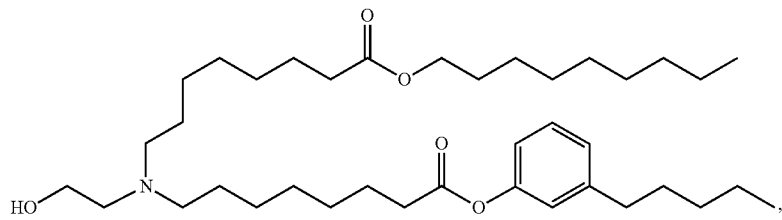
(Compound 120)
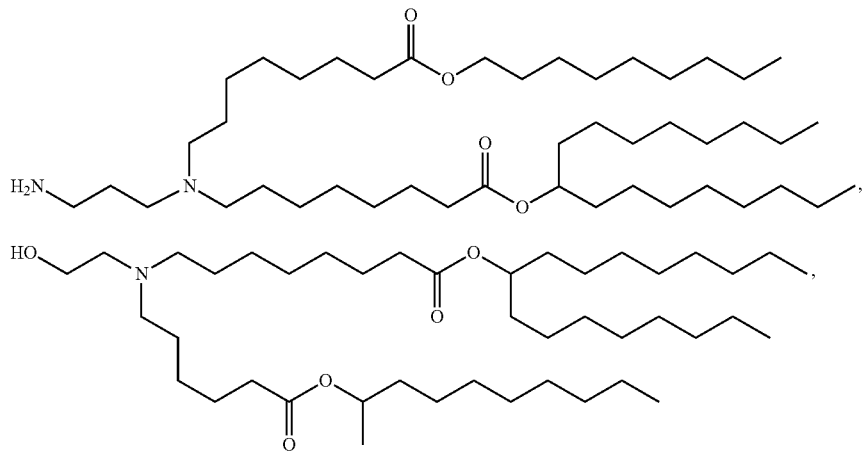
(Compound 121)
(Compound 122)
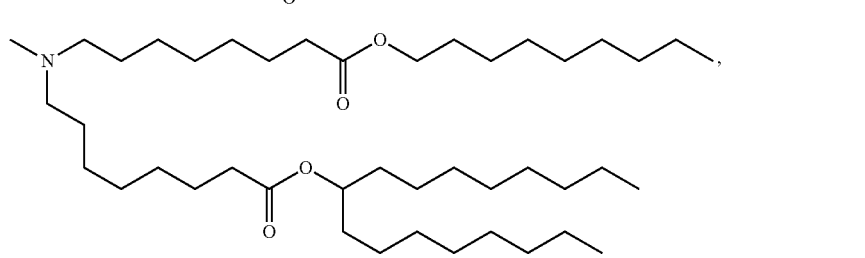
(Compound 123)
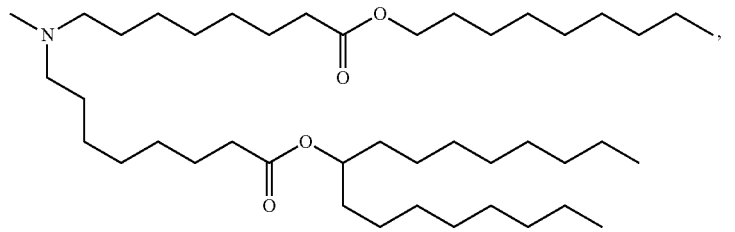
(Compound 124)
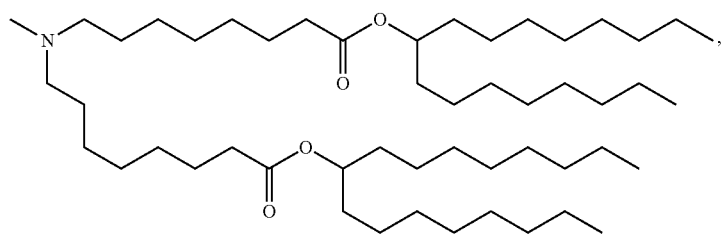
(Compound 125)
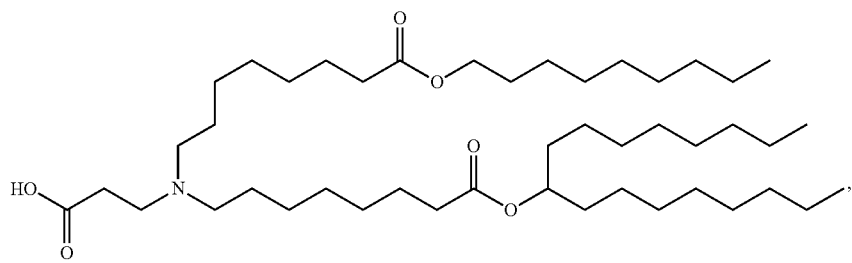

(Compound 126)
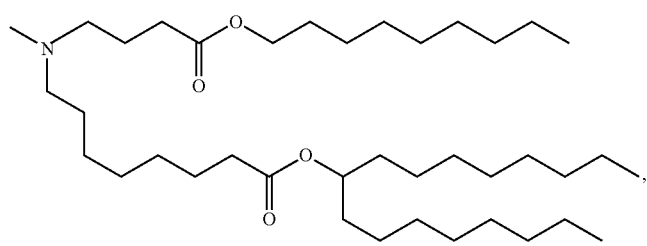
(Compound 127)
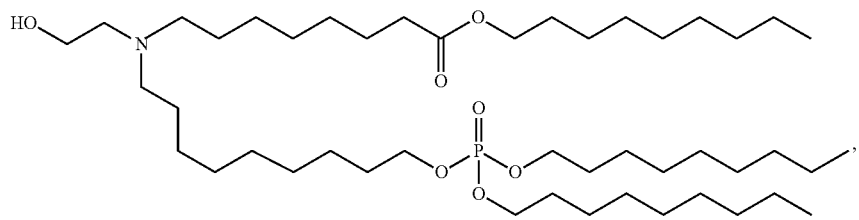
(Compound 128)
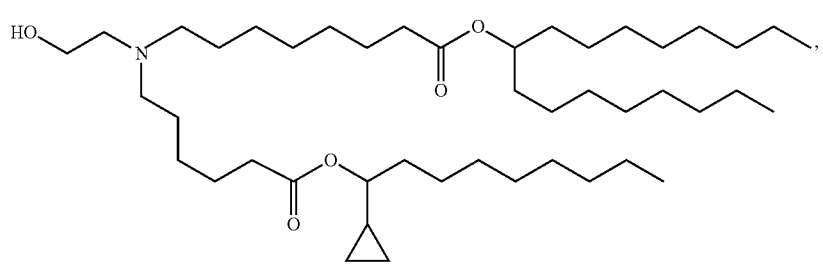
(Compound 129)
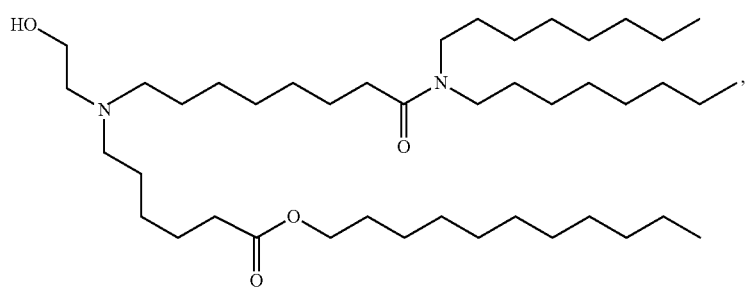
(Compound 130)
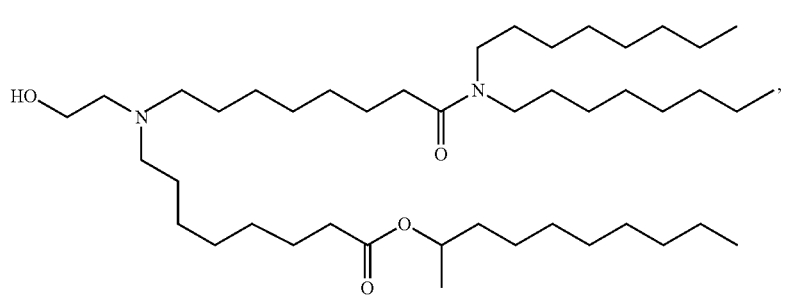
(Compound 131)
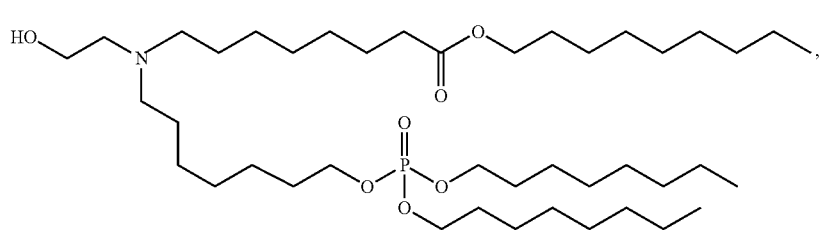

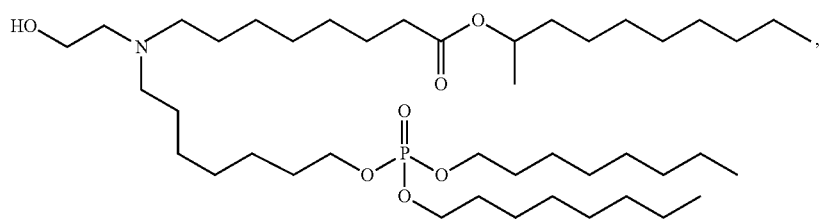
(Compound 132)
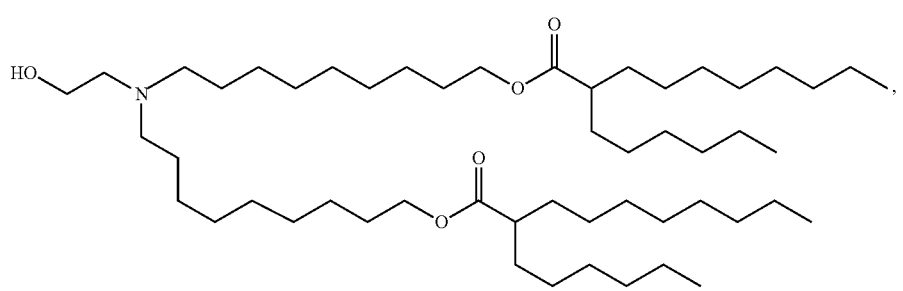
(Compound 133)
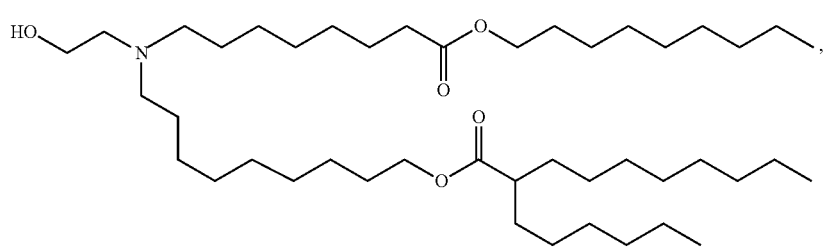
(Compound 134)
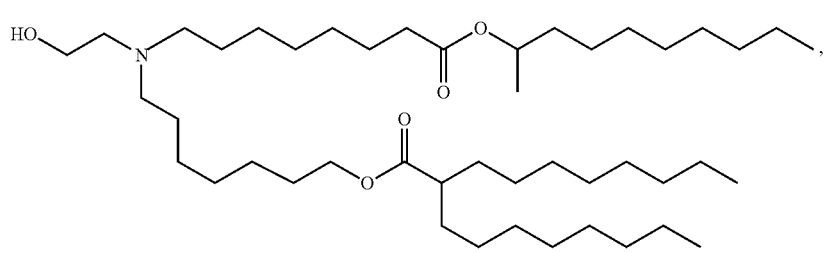
(Compound 135)
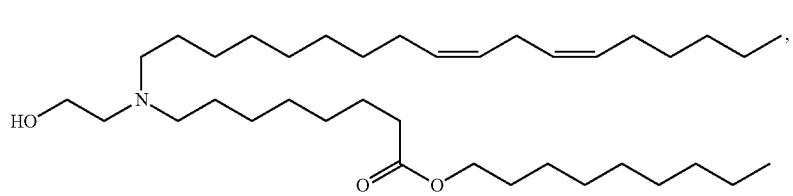
(Compound 136)
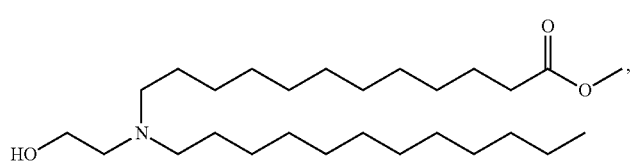
(Compound 137)
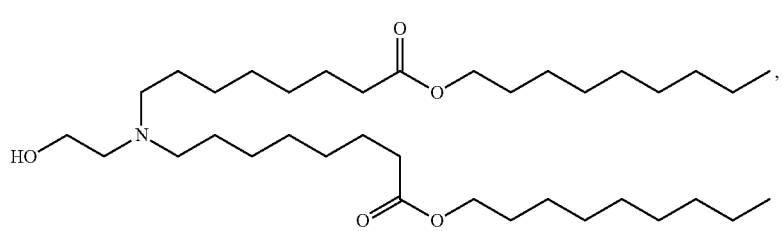
(Compound 138)

(Compound 139)
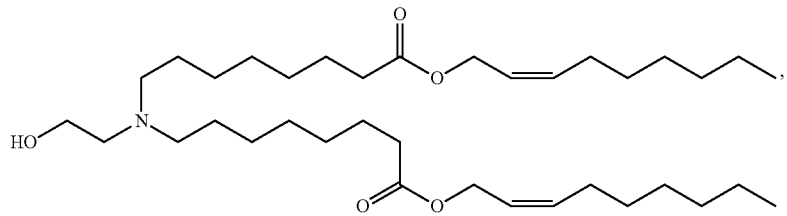
(Compound 140)
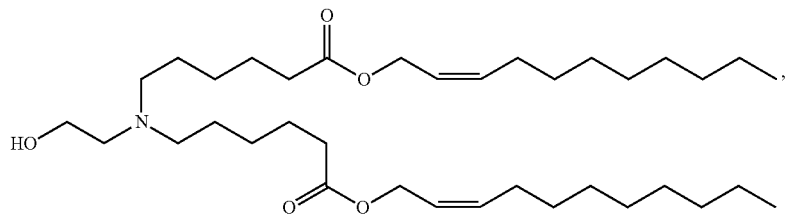
(Compound 141)
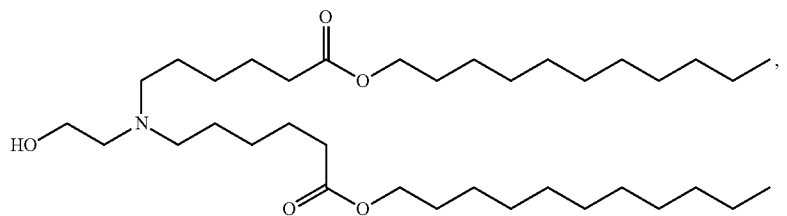
(Compound 142)
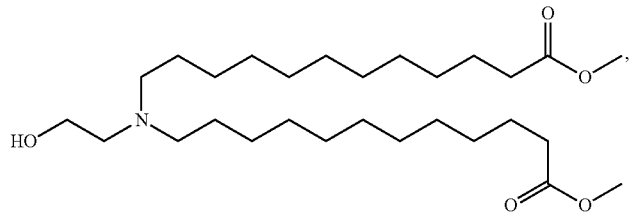
(Compound 143)
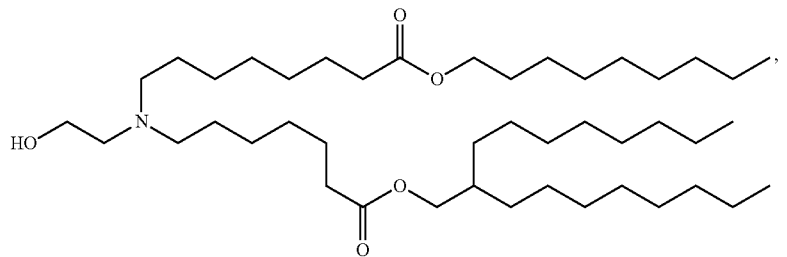
(Compound 144)
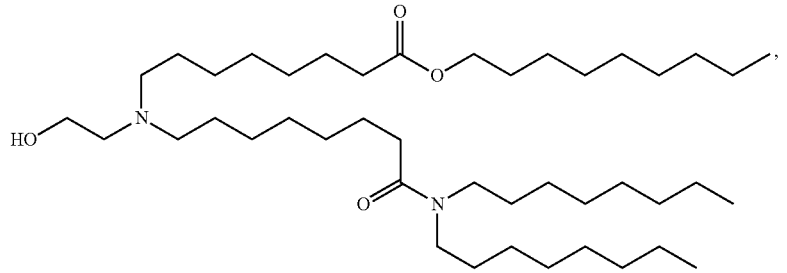

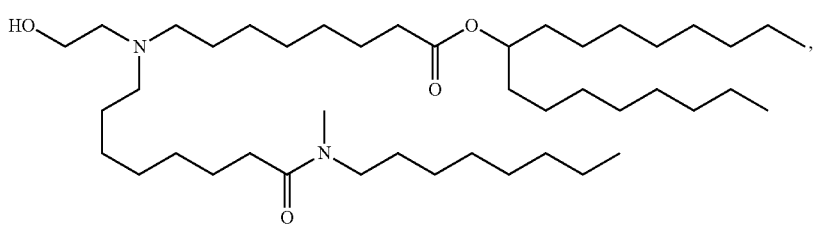
(Compound 145)

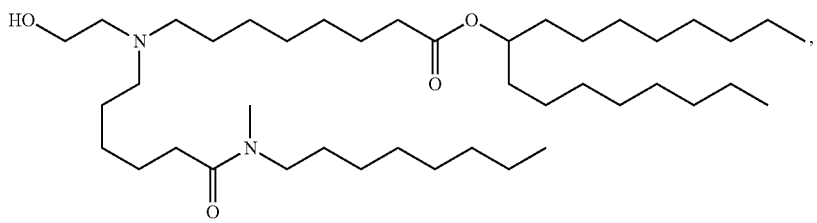
(Compound 146)

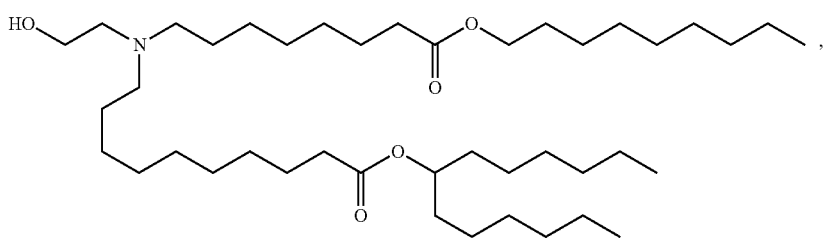
(Compound 147)

The central amine moiety of a lipid according to formula (I) is typically protonated (i.e., positively charged) at a pH below the pKa of the amino moiety and is substantially not charged at a pH above the pKa. Such lipids can be referred to ionizable amino lipids.

In one specific embodiment, the compound of formula (I) is Compound 18.

In some embodiments, the amount of the compound of formula (I) ranges from about 1 mol % to 99 mol % in the lipid composition.

In one embodiment, the amount of the compound of formula (I) is at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 mol % in the lipid composition.

In one embodiment, the amount of the compound of formula (I) ranges from about 30 mol % to about 70 mol %, from about 35 mol % to about 65 mol %, from about 40 mol % to about 60 mol %, and from about 45 mol % to about 55 mol % in the lipid composition.

In one specific embodiment, the amount of the compound of formula (I) is about 50 mol % in the lipid composition.

In addition to the compound of formula (I), the lipid composition of the pharmaceutical compositions disclosed herein can comprise additional components such as phospholipids, structural lipids, quaternary amine compounds, PEG-lipids, and any combination thereof.

b. Additional Components in the Lipid Composition
(i) Phospholipids

The lipid composition of the pharmaceutical composition disclosed herein can comprise one or more phospholipids, for example, one or more saturated or (poly)unsaturated phospholipids or a combination thereof. In general, phospholipids comprise a phospholipid moiety and one or more fatty acid moieties. For example, a phospholipid can be a lipid according to formula (III):

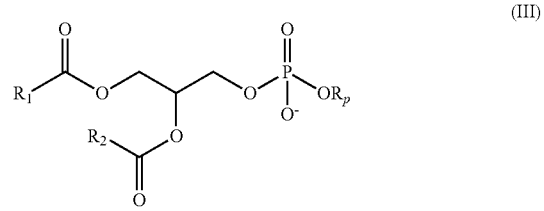

in which $R_p$ represents a phospholipid moiety and $R_1$ and $R_2$ represent fatty acid moieties with or without unsaturation that can be the same or different.

A phospholipid moiety can be selected, for example, from the non-limiting group consisting of phosphatidyl choline, phosphatidyl ethanolamine, phosphatidyl glycerol, phosphatidyl serine, phosphatidic acid, 2-lysophosphatidyl choline, and a sphingomyelin.

A fatty acid moiety can be selected, for example, from the non-limiting group consisting of lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, and docosahexaenoic acid.

Particular phospholipids can facilitate fusion to a membrane. For example, a cationic phospholipid can interact with one or more negatively charged phospholipids of a membrane (e.g., a cellular or intracellular membrane). Fusion of a phospholipid to a membrane can allow one or more elements (e.g., a therapeutic agent) of a lipid-containing composition (e.g., LNPs) to pass through the membrane permitting, e.g., delivery of the one or more elements to a target tissue (e.g., tumoral tissue).

Non-natural phospholipid species including natural species with modifications and substitutions including branching, oxidation, cyclization, and alkynes are also contemplated. For example, a phospholipid can be functionalized with or cross-linked to one or more alkynes (e.g., an alkenyl group in which one or more double bonds is replaced with a triple bond). Under appropriate reaction conditions, an alkyne group can undergo a copper-catalyzed cycloaddition upon exposure to an azide. Such reactions can be useful in functionalizing a lipid bilayer of a nanoparticle composition to facilitate membrane permeation or cellular recognition or in conjugating a nanoparticle composition to a useful component such as a targeting or imaging moiety (e.g., a dye).

Phospholipids include, but are not limited to, glycerophospholipids such as phosphatidylcholines, phosphatidylethanolamines, phosphatidylserines, phosphatidylinositols, phosphatidy glycerols, and phosphatidic acids. Phospholipids also include phosphosphingolipid, such as sphingomyelin. In some embodiments, a pharmaceutical composition for intratumoral delivery disclosed herein can comprise more than one phospholipid. When more than one phospholipid is used, such phospholipids can belong to the same phospholipid class (e.g., MSPC and DSPC) or different classes (e.g., MSPC and MSPE).

Phospholipids can be of a symmetric or an asymmetric type. As used herein, the term "symmetric phospholipid" includes glycerophospholipids having matching fatty acid moieties and sphingolipids in which the variable fatty acid moiety and the hydrocarbon chain of the sphingosine backbone include a comparable number of carbon atoms. As used herein, the term "asymmetric phospholipid" includes lysolipids, glycerophospholipids having different fatty acid moieties (e.g., fatty acid moieties with different numbers of carbon atoms and/or unsaturations (e.g., double bonds)), and sphingolipids in which the variable fatty acid moiety and the hydrocarbon chain of the sphingosine backbone include a dissimilar number of carbon atoms (e.g., the variable fatty acid moiety include at least two more carbon atoms than the hydrocarbon chain or at least two fewer carbon atoms than the hydrocarbon chain).

In some embodiments, the lipid composition of a pharmaceutical composition disclosed herein comprises at least one symmetric phospholipid. Symmetric phospholipids can be selected from the non-limiting group consisting of 1,2-dipropionyl-sn-glycero-3-phosphocholine (03:0 PC), 1,2-dibutyryl-sn-glycero-3-phosphocholine (04:0 PC), 1,2-dipentanoyl-sn-glycero-3-phosphocholine (05:0 PC), 1,2-dihexanoyl-sn-glycero-3-phosphocholine (06:0 PC), 1,2-diheptanoyl-sn-glycero-3-phosphocholine (07:0 PC), 1,2-dioctanoyl-sn-glycero-3-phosphocholine (08:0 PC), 1,2-dinonanoyl-sn-glycero-3-phosphocholine (09:0 PC), 1,2-didecanoyl-sn-glycero-3-phosphocholine (10:0 PC), 1,2-diundecanoyl-sn-glycero-3-phosphocholine (11:0 PC, DUPC), 1,2-dilauroyl-sn-glycero-3-phosphocholine (12:0 PC), 1,2-ditridecanoyl-sn-glycero-3-phosphocholine (13:0 PC), 1,2-dimyristoyl-sn-glycero-3-phosphocholine (14:0 PC, DMPC), 1,2-dipentadecanoyl-sn-glycero-3-phosphocholine (15:0 PC), 1,2-dipalmitoyl-sn-glycero-3-phosphocholine (16:0 PC, DPPC), 1,2-diphytanoyl-sn-glycero-3-phosphocholine (4ME 16:0 PC), 1,2-diheptadecanoyl-sn-glycero-3-phosphocholine (17:0 PC), 1,2-distearoyl-sn-glycero-3-phosphocholine (18:0 PC, DSPC), 1,2-dinonadecanoyl-sn-glycero-3-phosphocholine (19:0 PC), 1,2-diarachidoyl-sn-glycero-3-phosphocholine (20:0 PC), 1,2-dihenarachidoyl-sn-glycero-3-phosphocholine (21:0 PC), 1,2-dibehenoyl-sn-glycero-3-phosphocholine (22:0 PC), 1,2-ditricosanoyl-sn-glycero-3-phosphocholine (23:0 PC), 1,2-dilignoceroyl-sn-glycero-3-phosphocholine (24:0 PC), 1,2-dimyristoleoyl-sn-glycero-3-phosphocholine (14:1 (Δ9-Cis) PC), 1,2-dimyristelaidoyl-sn-glycero-3-phosphocholine (14:1 (Δ9-Trans) PC), 1,2-dipalmitoleoyl-sn-glycero-3-phosphocholine (16:1 (Δ9-Cis) PC), 1,2-dipalmitelaidoyl-sn-glycero-3-phosphocholine (16:1 (Δ9-Trans) PC), 1,2-dipetroselenoyl-sn-glycero-3-phosphocholine (18:1 (Δ6-Cis) PC), 1,2-dioleoyl-sn-glycero-3-phosphocholine (18:1 (Δ9-Cis) PC, DOPC), 1,2-dielaidoyl-sn-glycero-3-phosphocholine (18:1 (Δ9-Trans) PC), 1,2-dilinoleoyl-sn-glycero-3-phosphocholine (18:2 (Cis) PC, DLPC), 1,2-dilinolenoyl-sn-glycero-3-phosphocholine (18:3 (Cis) PC, DLnPC), 1,2-dieicosenoyl-sn-glycero-3-phosphocholine (20:1 (Cis) PC), 1,2-diarachidonoyl-sn-glycero-3-phosphocholine (20:4 (Cis) PC, DAPC), 1,2-dierucoyl-sn-glycero-3-phosphocholine (22:1 (Cis) PC), 1,2-didocosahexaenoyl-sn-glycero-3-phosphocholine (22:6 (Cis) PC, DHAPC), 1,2-dinervonoyl-sn-glycero-3-phosphocholine (24:1 (Cis) PC), 1,2-dihexanoyl-sn-glycero-3-phosphoethanolamine (06:0 PE), 1,2-dioctanoyl-sn-glycero-3-phosphoethanolamine (08:0 PE), 1,2-didecanoyl-sn-glycero-3-phosphoethanolamine (10:0 PE), 1,2-dilauroyl-sn-glycero-3-phosphoethanolamine (12:0 PE), 1,2-dimyristoyl-sn-glycero-3-phosphoethanolamine (14:0 PE), 1,2-dipentadecanoyl-sn-glycero-3-phosphoethanolamine (15:0 PE), 1,2-dipalmitoyl-sn-glycero-3-phosphoethanolamine (16:0 PE), 1,2-diphytanoyl-sn-glycero-3-phosphoethanolamine (4ME 16:0 PE), 1,2-diheptadecanoyl-sn-glycero-3-phosphoethanolamine (17:0 PE), 1,2-di stearoyl-sn-glycero-3-phosphoethanolamine (18:0 PE, DSPE), 1,2-dipalmitoleoyl-sn-glycero-3-phosphoethanolamine (16:1 PE), 1,2-dioleoyl-sn-glycero-3-phosphoethanolamine (18:1 (Δ9-Cis) PE, DOPE), 1,2-dielaidoyl-sn-glycero-3-phosphoethanolamine (18:1 (Δ9-Trans) PE), 1,2-dilinoleoyl-sn-glycero-3-phosphoethanolamine (18:2 PE, DLPE), 1,2-dilinolenoyl-sn-glycero-3-phosphoethanolamine (18:3 PE, DLnPE),
1,2-diarachidonoyl-sn-glycero-3-phosphoethanolamine (20:4 PE, DAPE),
1,2-didocosahexaenoyl-sn-glycero-3-phosphoethanolamine (22:6 PE, DHAPE),
1,2-di-O-octadecenyl-sn-glycero-3-phosphocholine (18:0 Diether PC),
1,2-dioleoyl-sn-glycero-3-phospho-rac-(1-glycerol) sodium salt (DOPG), and
any combination thereof.

In some embodiments, the lipid composition of a pharmaceutical composition disclosed herein comprises at least one symmetric phospholipid selected from the non-limiting group consisting of DLPC, DMPC, DOPC, DPPC, DSPC, DUPC, 18:0 Diether PC, DLnPC, DAPC, DHAPC, DOPE, 4ME 16:0 PE, DSPE, DLPE, DLnPE, DAPE, DHAPE, DOPG, and any combination thereof.

In some embodiments, the lipid composition of a pharmaceutical composition disclosed herein comprises at least one asymmetric phospholipid. Asymmetric phospholipids can be selected from the non-limiting group consisting of
1-myristoyl-2-palmitoyl-sn-glycero-3-phosphocholine (14:0-16:0 PC, MPPC),
1-myristoyl-2-stearoyl-sn-glycero-3-phosphocholine (14:0-18:0 PC, MSPC),
1-palmitoyl-2-acetyl-sn-glycero-3-phosphocholine (16:0-02:0 PC),
1-palmitoyl-2-myristoyl-sn-glycero-3-phosphocholine (16:0-14:0 PC, PMPC),
1-palmitoyl-2-stearoyl-sn-glycero-3-phosphocholine (16:0-18:0 PC, PSPC),
1-palmitoyl-2-oleoyl-sn-glycero-3-phosphocholine (16:0-18:1 PC, POPC),
1-palmitoyl-2-linoleoyl-sn-glycero-3-phosphocholine (16:0-18:2 PC, PLPC),
1-palmitoyl-2-arachidonoyl-sn-glycero-3-phosphocholine (16:0-20:4 PC),
1-palmitoyl-2-docosahexaenoyl-sn-glycero-3-phosphocholine (14:0-22:6 PC),
1-stearoyl-2-myristoyl-sn-glycero-3-phosphocholine (18:0-14:0 PC, SMPC),
1-stearoyl-2-palmitoyl-sn-glycero-3-phosphocholine (18:0-16:0 PC, SPPC),
1-stearoyl-2-oleoyl-sn-glycero-3-phosphocholine (18:0-18:1 PC, SOPC),
1-stearoyl-2-linoleoyl-sn-glycero-3-phosphocholine (18:0-18:2 PC),
1-stearoyl-2-arachidonoyl-sn-glycero-3-phosphocholine (18:0-20:4 PC),
1-stearoyl-2-docosahexaenoyl-sn-glycero-3-phosphocholine (18:0-22:6 PC),
1-oleoyl-2-myristoyl-sn-glycero-3-phosphocholine (18:1-14:0 PC, OMPC),
1-oleoyl-2-palmitoyl-sn-glycero-3-phosphocholine (18:1-16:0 PC, OPPC),
1-oleoyl-2-stearoyl-sn-glycero-3-phosphocholine (18:1-18:0 PC, OSPC),
1-palmitoyl-2-oleoyl-sn-glycero-3-phosphoethanolamine (16:0-18:1 PE, POPE),
1-palmitoyl-2-linoleoyl-sn-glycero-3-phosphoethanolamine (16:0-18:2 PE),
1-palmitoyl-2-arachidonoyl-sn-glycero-3-phosphoethanolamine (16:0-20:4 PE),
1-palmitoyl-2-docosahexaenoyl-sn-glycero-3-phosphoethanolamine (16:0-22:6 PE),
1-stearoyl-2-oleoyl-sn-glycero-3-phosphoethanolamine (18:0-18:1 PE),
1-stearoyl-2-linoleoyl-sn-glycero-3-phosphoethanolamine (18:0-18:2 PE),
1-stearoyl-2-arachidonoyl-sn-glycero-3-phosphoethanolamine (18:0-20:4 PE),
1-stearoyl-2-docosahexaenoyl-sn-glycero-3-phosphoethanolamine (18:0-22:6 PE),
1-oleoyl-2-cholesterylhemisuccinoyl-sn-glycero-3-phosphocholine (OChemsPC), and
any combination thereof.

Asymmetric lipids useful in the lipid composition can also be lysolipids. Lysolipids can be selected from the non-limiting group consisting of
1-hexanoyl-2-hydroxy-sn-glycero-3-phosphocholine (06:0 Lyso PC),
1-heptanoyl-2-hydroxy-sn-glycero-3-phosphocholine (07:0 Lyso PC),
1-octanoyl-2-hydroxy-sn-glycero-3-phosphocholine (08:0 Lyso PC),
1-nonanoyl-2-hydroxy-sn-glycero-3-phosphocholine (09:0 Lyso PC),
1-decanoyl-2-hydroxy-sn-glycero-3-phosphocholine (10:0 Lyso PC),
1-undecanoyl-2-hydroxy-sn-glycero-3-phosphocholine (11:0 Lyso PC),
1-lauroyl-2-hydroxy-sn-glycero-3-phosphocholine (12:0 Lyso PC),
1-tridecanoyl-2-hydroxy-sn-glycero-3-phosphocholine (13:0 Lyso PC),
1-myristoyl-2-hydroxy-sn-glycero-3-phosphocholine (14:0 Lyso PC),
1-pentadecanoyl-2-hydroxy-sn-glycero-3-phosphocholine (15:0 Lyso PC),
1-palmitoyl-2-hydroxy-sn-glycero-3-phosphocholine (16:0 Lyso PC),
1-heptadecanoyl-2-hydroxy-sn-glycero-3-phosphocholine (17:0 Lyso PC),
1-stearoyl-2-hydroxy-sn-glycero-3-phosphocholine (18:0 Lyso PC),
1-oleoyl-2-hydroxy-sn-glycero-3-phosphocholine (18:1 Lyso PC),
1-nonadecanoyl-2-hydroxy-sn-glycero-3-phosphocholine (19:0 Lyso PC),
1-arachidoyl-2-hydroxy-sn-glycero-3-phosphocholine (20:0 Lyso PC),
1-behenoyl-2-hydroxy-sn-glycero-3-phosphocholine (22:0 Lyso PC),
1-lignoceroyl-2-hydroxy-sn-glycero-3-phosphocholine (24:0 Lyso PC),
1-hexacosanoyl-2-hydroxy-sn-glycero-3-phosphocholine (26:0 Lyso PC),
1-myristoyl-2-hydroxy-sn-glycero-3-phosphoethanolamine (14:0 Lyso PE),
1-palmitoyl-2-hydroxy-sn-glycero-3-phosphoethanolamine (16:0 Lyso PE),
1-stearoyl-2-hydroxy-sn-glycero-3-phosphoethanolamine (18:0 Lyso PE),
1-oleoyl-2-hydroxy-sn-glycero-3-phosphoethanolamine (18:1 Lyso PE),
1-hexadecyl-sn-glycero-3-phosphocholine (C16 Lyso PC), and
any combination thereof.

In some embodiment, the lipid composition of a pharmaceutical composition disclosed herein comprises at least one asymmetric phospholipid selected from the group consisting of MPPC, MSPC, PMPC, PSPC, SMPC, SPPC, and any combination thereof. In some embodiments, the asymmetric phospholipid is 1-myristoyl-2-stearoyl-sn-glycero-3-phosphocholine (MSPC).

In some embodiments, the lipid compositions disclosed herein can contain one or more symmetric phospholipids, one or more asymmetric phospholipids, or a combination thereof. When multiple phospholipids are present, they can be present in equimolar ratios, or non-equimolar ratios.

In one embodiment, the lipid composition of a pharmaceutical composition disclosed herein comprises a total amount of phospholipid (e.g., MSPC) which ranges from about 1 mol % to about 20 mol %, from about 5 mol % to about 20 mol %, from about 10 mol % to about 20 mol %, from about 15 mol % to about 20 mol %, from about 1 mol % to about 15 mol %, from about 5 mol % to about 15 mol %, from about 10 mol % to about 15 mol %, from about 5 mol % to about 10 mol % in the lipid composition. In one embodiment, the amount of the phospholipid is from about 8 mol % to about 15 mol % in the lipid composition. In one embodiment, the amount of the phospholipid (e.g., MSPC) is about 10 mol % in the lipid composition.

In some aspects, the amount of a specific phospholipid (e.g., MSPC) is at least about 1, 2, 3, 4, 5, 6, 7, 8, 9, 10, 11, 12, 13, 14, 15, 16, 17, 18, 19 or 20 mol % in the lipid composition.

(ii) Quaternary Amine Compounds

The lipid composition of a pharmaceutical composition disclosed herein can comprise one or more quaternary amine compounds (e.g., DOTAP). The term "quaternary amine compound" is used to include those compounds having one or more quaternary amine groups (e.g., trialkylamino groups) and permanently carrying a positive charge and existing in a form of a salt. For example, the one or more quaternary amine groups can be present in a lipid or a polymer (e.g., PEG). In some embodiments, the quaternary amine compound comprises (1) a quaternary amine group and (2) at least one hydrophobic tail group comprising (i) a hydrocarbon chain, linear or branched, and saturated or unsaturated, and (ii) optionally an ether, ester, carbonyl, or ketal linkage between the quaternary amine group and the hydrocarbon chain. In some embodiments, the quaternary amine group can be a trimethylammonium group. In some embodiments, the quaternary amine compound comprises two identical hydrocarbon chains. In some embodiments, the quaternary amine compound comprises two different hydrocarbon chains.

In some embodiments, the lipid composition of a pharmaceutical composition disclosed herein comprises at least one quaternary amine compound. Quaternary amine compound can be selected from the non-limiting group consisting of 1,2-dioleoyl-3-trimethylammonium-propane (DOTAP),
N-[1-(2,3-dioleoyloxy)propyl]-N,N,N-trimethylammonium chloride (DOTMA),
1-[2-(oleoyloxy)ethyl]-2-oleyl-3-(2-hydroxyethyl)imidazolinium chloride (DOTIM),
2,3-dioleyloxy-N-[2(sperminecarboxamido)ethyl]-N,N-dimethyl-1-propanaminium trifluoroacetate (DOSPA),
N,N-distearyl-N,N-dimethylammonium bromide (DDAB),
N-(1,2-dimyristyloxyprop-3-yl)-N,N-dimethyl-N-hydroxyethyl ammonium bromide (DMRIE),
N-(1,2-dioleoyloxyprop-3-yl)-N,N-dimethyl-N-hydroxyethyl ammonium bromide (DORIE),
N,N-dioleyl-N,N-dimethylammonium chloride (DODAC),
1,2-dilauroyl-sn-glycero-3-ethylphosphocholine (DLePC),
1,2-distearoyl-3-trimethylammonium-propane (DSTAP),
1,2-dipalmitoyl-3-trimethylammonium-propane (DPTAP),
1,2-dilinoleoyl-3-trimethylammonium-propane (DLTAP),
1,2-dimyristoyl-3-trimethylammonium-propane (DMTAP)
1,2-distearoyl-sn-glycero-3-ethylphosphocholine (DSePC)
1,2-dipalmitoyl-sn-glycero-3-ethylphosphocholine (DPePC),
1,2-dimyristoyl-sn-glycero-3-ethylphosphocholine (DMePC),
1,2-dioleoyl-sn-glycero-3-ethylphosphocholine (DOePC),
1,2-di-(9Z-tetradecenoyl)-sn-glycero-3-ethylphosphocholine (14:1 EPC),
1-palmitoyl-2-oleoyl-sn-glycero-3-ethylphosphocholine (16:0-18:1 EPC),
and any combination thereof.

In one embodiment, the quaternary amine compound is 1,2-dioleoyl-3-trimethylammonium-propane (DOTAP).

Quaternary amine compounds are known in the art, such as those described in US 2013/0245107 A1, US 2014/0363493 A1, U.S. Pat. No. 8,158,601, WO 2015/123264 A1, and WO 2015/148247 A1, which are incorporated herein by reference in their entirety.

In one embodiment, the amount of the quaternary amine compound (e.g., DOTAP) in the lipid composition disclosed herein ranges from about 0.01 mol % to about 20 mol %.

In one embodiment, the amount of the quaternary amine compound (e.g., DOTAP) in the lipid composition disclosed herein ranges from about 0.5 mol % to about 20 mol %, from about 0.5 mol % to about 15 mol %, from about 0.5 mol % to about 10 mol %, from about 1 mol % to about 20 mol %, from about 1 mol % to about 15 mol %, from about 1 mol % to about 10 mol %, from about 2 mol % to about 20 mol %, from about 2 mol % to about 15 mol %, from about 2 mol % to about 10 mol %, from about 3 mol % to about 20 mol %, from about 3 mol % to about 15 mol %, from about 3 mol % to about 10 mol %, from about 4 mol % to about 20 mol %, from about 4 mol % to about 15 mol %, from about 4 mol % to about 10 mol %, from about 5 mol % to about 20 mol %, from about 5 mol % to about 15 mol %, from about 5 mol % to about 10 mol %, from about 6 mol % to about 20 mol %, from about 6 mol % to about 15 mol %, from about 6 mol % to about 10 mol %, from about 7 mol % to about 20 mol %, from about 7 mol % to about 15 mol %, from about 7 mol % to about 10 mol %, from about 8 mol % to about 20 mol %, from about 8 mol % to about 15 mol %, from about 8 mol % to about 10 mol %, from about 9 mol % to about 20 mol %, from about 9 mol % to about 15 mol %, from about 9 mol % to about 10 mol %.

In one embodiment, the amount of the quaternary amine compound (e.g., DOTAP) in the lipid composition disclosed herein ranges from about 5 mol % to about 10 mol %.

In one embodiment, the amount of the quaternary amine compound (e.g., DOTAP) in the lipid composition disclosed herein is about 5 mol %. In one embodiment, the amount of the quaternary amine compound (e.g., DOTAP) in the lipid composition disclosed herein is about 10 mol %.

In some embodiments, the amount of the quaternary amine compound (e.g., DOTAP) is at least about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5, 10, 10.5, 11, 11.5, 12, 12.5, 13, 13.5, 14, 14.5, 15, 15.5, 16, 16.5, 17, 17.5, 18, 18.5, 19, 19.5 or 20 mol % in the lipid composition disclosed herein.

In one embodiment, the mole ratio of the compound of formula (I) (e.g., Compounds 18, 25, 26 or 48) to the quaternary amine compound (e.g., DOTA) is about 100:1 to about 2.5:1. In one embodiment, the mole ratio of the compound of formula (I) (e.g., Compounds 18, 25, 26 or 48) to the quaternary amine compound (e.g., DOTAP) is about 90:1, about 80:1, about 70:1, about 60:1, about 50:1, about 40:1, about 30:1, about 20:1, about 15:1, about 10:1, about 9:1, about 8:1, about 7:1, about 6:1, about 5:1, or about 2.5:1. In one embodiment, the mole ratio of the compound of formula (I) (e.g., Compounds 18, 25, 26 or 48) to the quaternary amine compound (e.g., DOTAP) in the lipid composition disclosed herein is about 10:1.

In some aspects, the lipid composition the pharmaceutical compositions disclosed herein does not comprise a quaternary amine compound. In some aspects, the lipid composition of the pharmaceutical compositions disclosed does not comprise DOTAP.

(iii) Structural Lipids

The lipid composition of a pharmaceutical composition disclosed herein can comprise one or more structural lipids. As used herein, the term "structural lipid" refers to sterols and also to lipids containing sterol moieties. In some embodiments, the structural lipid is selected from the group consisting of cholesterol, fecosterol, sitosterol, ergosterol, campesterol, stigmasterol, brassicasterol, tomatidine, tomatine, ursolic acid, alpha-tocopherol, and mixtures thereof. In some embodiments, the structural lipid is cholesterol.

In one embodiment, the amount of the structural lipid (e.g., an sterol such as cholesterol) in the lipid composition of a pharmaceutical composition disclosed herein ranges from about 20 mol % to about 60 mol %, from about 25 mol % to about 55 mol %, from about 30 mol % to about 50 mol %, or from about 35 mol % to about 45 mol %.

In one embodiment, the amount of the structural lipid (e.g., an sterol such as cholesterol) in the lipid composition disclosed herein ranges from about 25 mol % to about 30 mol %, from about 30 mol % to about 35 mol %, or from about 35 mol % to about 40 mol %.

In one embodiment, the amount of the structural lipid (e.g., a sterol such as cholesterol) in the lipid composition disclosed herein is about 23.5 mol %, about 28.5 mol %, about 33.5 mol %, or about 38.5 mol %.

In some embodiments, the amount of the structural lipid (e.g., an sterol such as cholesterol) in the lipid composition disclosed herein is at least about 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 mol %.

In some aspects, the lipid composition component of the pharmaceutical compositions for intratumoral delivery disclosed does not comprise cholesterol.

(iv) Polyethylene Glycol (PEG)-Lipids

The lipid composition of a pharmaceutical composition disclosed herein can comprise one or more a polyethylene glycol (PEG) lipid.

As used herein, the term "PEG-lipid" refers to polyethylene glycol (PEG)-modified lipids. Non-limiting examples of PEG-lipids include PEG-modified phosphatidylethanolamine and phosphatidic acid, PEG-ceramide conjugates (e.g., PEG-CerC14 or PEG-CerC20), PEG-modified dialkylamines and PEG-modified 1,2-diacyloxypropan-3-amines. Such lipids are also referred to as PEGylated lipids. For example, a PEG lipid can be PEG-c-DOMG, PEG-DMG, PEG-DLPE, PEG-DMPE, PEG-DPPC, or a PEG-DSPE lipid.

In some embodiments, the PEG-lipid includes, but not limited to 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DSG), PEG-dipalmetoleyl, PEG-dioleyl, PEG-distearyl, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA).

In one embodiment, the PEG-lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the lipid moiety of the PEG-lipids includes those having lengths of from about $C_{14}$ to about $C_{22}$, preferably from about $C_{14}$ to about $C_{16}$. In some embodiments, a PEG moiety, for example an mPEG-NH$_2$, has a size of about 1000, 2000, 5000, 10,000, 15,000 or 20,000 daltons. In one embodiment, the PEG-lipid is PEG$_{2k}$-DMG.

In one embodiment, the lipid nanoparticles described herein can comprise a PEG lipid which is a non-diffusible PEG. Non-limiting examples of non-diffusible PEGs include PEG-DSG and PEG-DSPE.

PEG-lipids are known in the art, such as those described in U.S. Pat. No. 8,158,601 and International Publ. No. WO 2015/130584 A2, which are incorporated herein by reference in their entirety.

In one embodiment, the amount of PEG-lipid in the lipid composition of a pharmaceutical composition disclosed herein ranges from about 0.1 mol % to about 5 mol %, from about 0.5 mol % to about 5 mol %, from about 1 mol % to about 5 mol %, from about 1.5 mol % to about 5 mol %, from about 2 mol % to about 5 mol % mol %, from about 0.1 mol % to about 4 mol %, from about 0.5 mol % to about 4 mol %, from about 1 mol % to about 4 mol %, from about 1.5 mol % to about 4 mol %, from about 2 mol % to about 4 mol %, from about 0.1 mol % to about 3 mol %, from about 0.5 mol % to about 3 mol %, from about 1 mol % to about 3 mol %, from about 1.5 mol % to about 3 mol %, from about 2 mol % to about 3 mol %, from about 0.1 mol % to about 2 mol %, from about 0.5 mol % to about 2 mol %, from about 1 mol % to about 2 mol %, from about 1.5 mol % to about 2 mol %, from about 0.1 mol % to about 1.5 mol %, from about 0.5 mol % to about 1.5 mol %, or from about 1 mol % to about 1.5 mol %.

In one embodiment, the amount of PEG-lipid in the lipid composition disclosed herein is about 1.5 mol %.

In one embodiment, the amount of PEG-lipid in the lipid composition disclosed herein is at least about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, or 5 mol %.

In some aspects, the lipid composition of the pharmaceutical compositions disclosed herein does not comprise a PEG-lipid.

In some embodiments, the lipid composition disclosed herein comprises a compound of formula (I) and an asymmetric phospholipid. In some embodiments, the lipid composition comprises compound 18 and MSPC.

In some embodiments, the lipid composition disclosed herein comprises a compound of formula (I) and a quaternary amine compound. In some embodiments, the lipid composition comprises compound 18 and DOTAP.

In some embodiments, the lipid composition disclosed herein comprises a compound of formula (I), an asymmetric phospholipid, and a quaternary amine compound. In some embodiments, the lipid composition comprises compound 18, MSPC and DOTAP.

In one embodiment, the lipid composition comprises about 50 mol % of a compound of formula (I) (e.g., Compounds 18, 25, 26 or 48), about 10 mol % of DSPC or MSPC, about 33.5 mol % of cholesterol, about 1.5 mol % of PEG-DMG, and about 5 mol % of DOTAP. In one embodiment, the lipid composition comprises about 50 mol % of a compound of formula (I) (e.g. Compounds 18, 25, 26 or 48), about 10 mol % of DSPC or MSPC, about 28.5 mol % of cholesterol, about 1.5 mol % of PEG-DMG, and about 10 mol % of DOTAP.

The components of the lipid nanoparticle can be tailored for optimal delivery of the polynucleotides based on the desired outcome. As a non-limiting example, the lipid nanoparticle can comprise 40-60 mol % a compound of formula (I), 8-16 mol % phospholipid, 30-45 mol % cholesterol, 1-5 mol % PEG lipid, and optionally 1-15 mol % quaternary amine compound.

In some embodiments, the lipid nanoparticle can comprise 45-65 mol % of a compound of formula (I), 5-10 mol % phospholipid, 25-40 mol % cholesterol, 0.5-5 mol % PEG lipid, and optionally 1-15 mol % quaternary amine compound.

Non-limiting examples of nucleic acid lipid particles are disclosed in U.S. Patent Publication No. 20140121263, herein incorporated by reference in its entirety.

(v) Other Ionizable Amino Lipids

The lipid composition of the pharmaceutical composition disclosed herein can comprise one or more ionizable amino lipids in addition to a lipid according to formula (I).

Ionizable lipids can be selected from the non-limiting group consisting of 3-(didodecylamino)-N1,N1,4-tridodecyl-1-piperazineethanamine (KL10), N1-[2-(didodecylamino)ethyl]-N1,N4,N4-tridodecyl-1,4-piperazinediethanamine (KL22), 14,25-ditridecyl-15,18,21,24-tetraazaoctatriacontane (KL25), 1,2-dilinoleyloxy-N,N-dimethylaminopropane (DLin-DMA), 2,2-dilinoleyl-4-dimethylaminomethyl-[1,3]-dioxolane (DLin-K-DMA), heptatriaconta-6,9,28,31-tetraen-19-yl 4-(dimethylamino) butanoate (DLin-MC3-DMA), 2,2-dilinoleyl-4-(2-dimethylaminoethyl)-[1,3]-dioxolane (DLin-KC2-DMA), 1,2-dioleyloxy-N,N-dimethylaminopropane (DODMA), (13Z, 16SZ)—N,N-dimethyl-3-nonydocosa-13-16-dien-1-amine (L608), 2-({8-[(3β)-cholest-5-en-3-yloxy]octyl}oxy)-N,N-dimethyl-3-[(9Z,12Z)-octadeca-9,12-dien-1-yl oxy]propan-1-amine (Octyl-CLinDMA), (2R)-2-({8-[(3β)-cholest-5-en-3-yloxy]octyl}oxy)-N,N-dimethyl-3-[(9Z,12Z)-octadeca-9,2-dien-1-yloxy]propan-1-amine (Octyl-CLinDMA (2R)), and (2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)). In addition to these, an ionizable amino lipid can also be a lipid including a cyclic amine group.

Ionizable lipids can also be the compounds disclosed in International Publication No. WO 2015/199952 A1, hereby incorporated by reference in its entirety. For example, the ionizable amino lipids include, but not limited to:

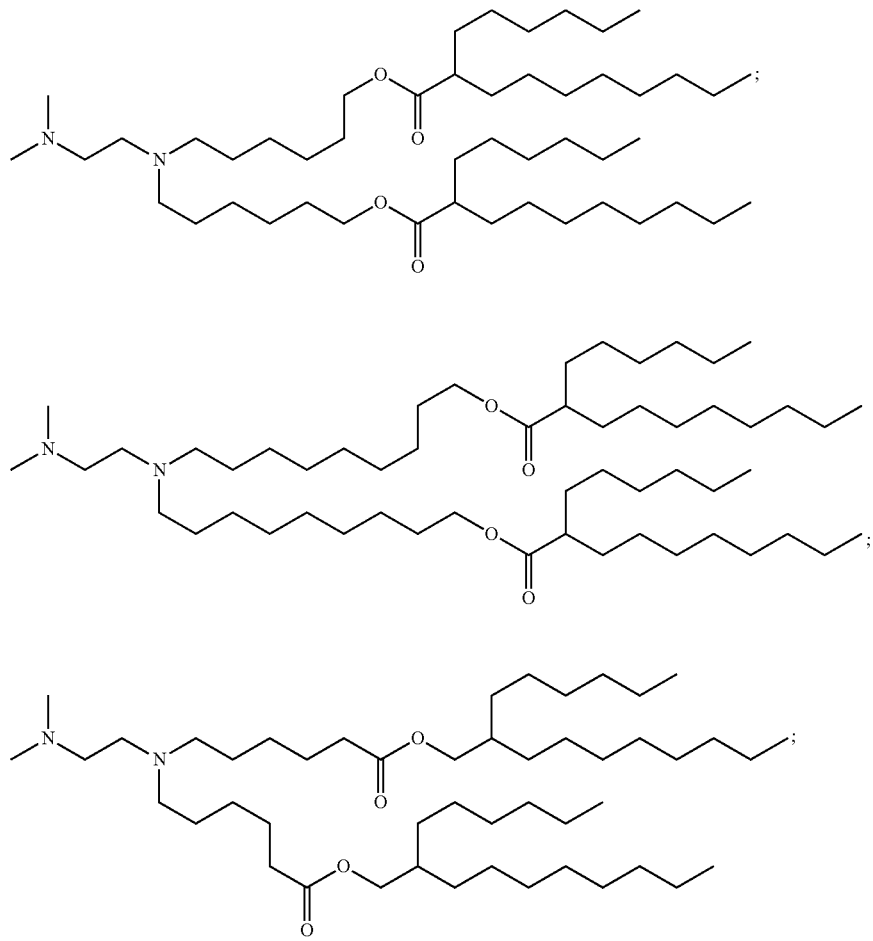

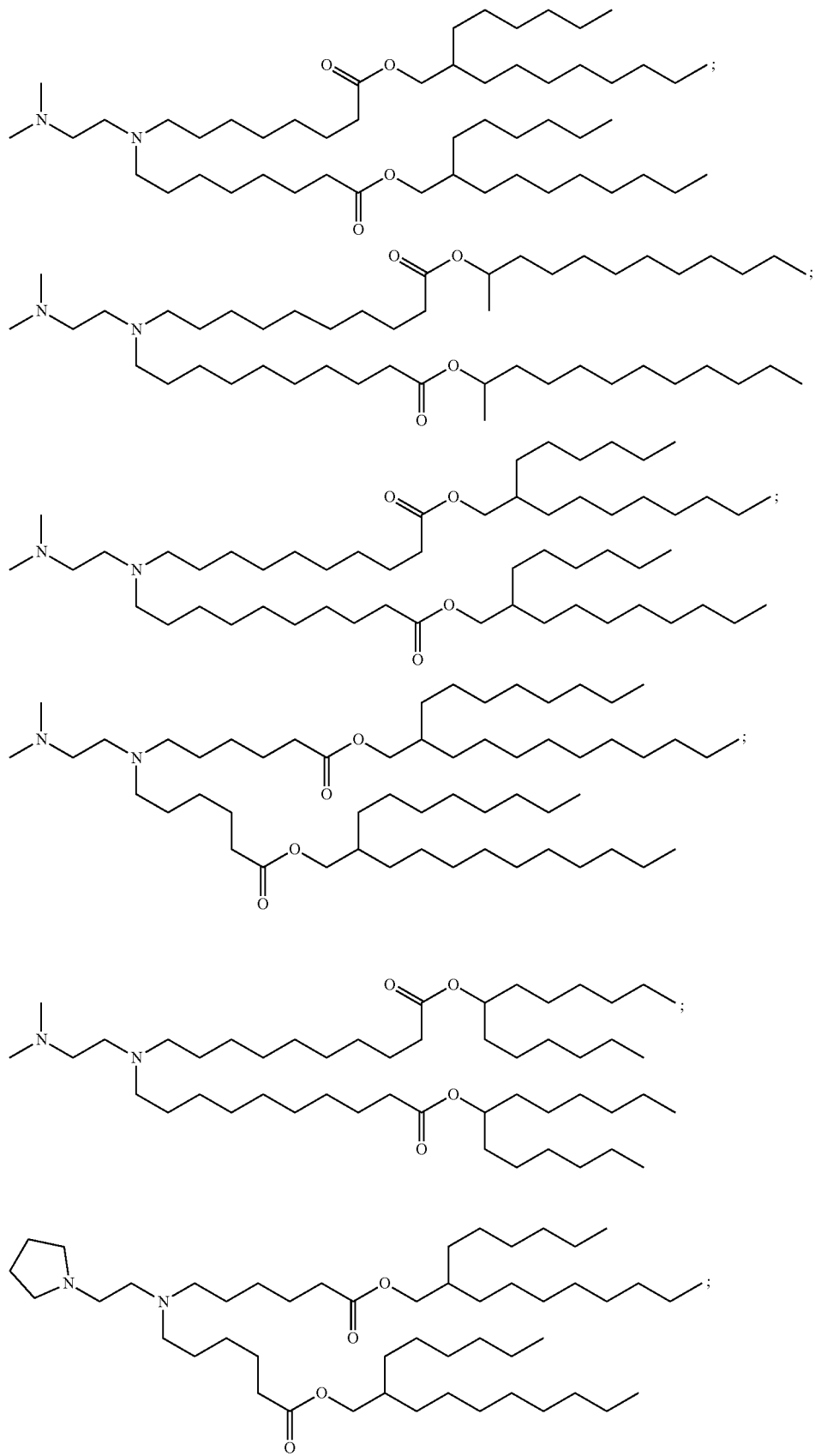

-continued

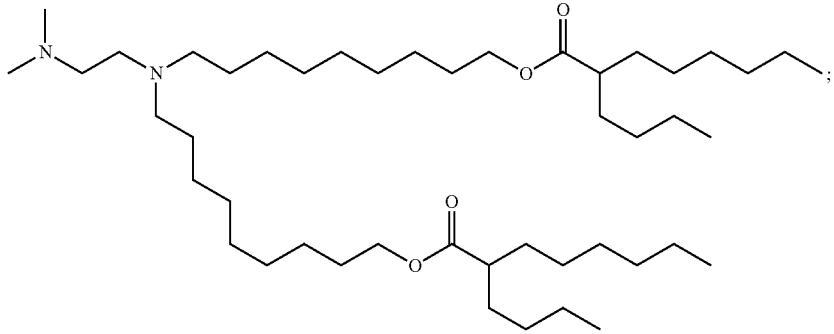

and any combination thereof.

(vi) Other Lipid Composition Components

The lipid composition of a pharmaceutical composition disclosed herein can include one or more components in addition to those described above. For example, the lipid composition can include one or more permeability enhancer molecules, carbohydrates, polymers, surface altering agents (e.g., surfactants), or other components. For example, a permeability enhancer molecule can be a molecule described by U.S. Patent Application Publication No. 2005/0222064. Carbohydrates can include simple sugars (e.g., glucose) and polysaccharides (e.g., glycogen and derivatives and analogs thereof). The lipid composition can include a buffer such as, but not limited to, citrate or phosphate at a pH of 7, salt and/or sugar. Salt and/or sugar can be included in the formulations described herein for isotonicity.

A polymer can be included in and/or used to encapsulate or partially encapsulate a pharmaceutical composition disclosed herein (e.g., a pharmaceutical composition in lipid nanoparticle form). A polymer can be biodegradable and/or biocompatible. A polymer can be selected from, but is not limited to, polyamines, polyethers, polyamides, polyesters, polycarbamates, polyureas, polycarbonates, polystyrenes, polyimides, polysulfones, polyurethanes, polyacetylenes, polyethylenes, polyethyleneimines, polyisocyanates, polyacrylates, polymethacrylates, polyacrylonitriles, and polyarylates.

The ratio between the lipid composition and the polynucleotide range can be from about 10:1 to about 60:1 (wt/wt).

In some embodiments, the ratio between the lipid composition and the polynucleotide can be about 10:1, 11:1, 12:1, 13:1, 14:1, 15:1, 16:1, 17:1, 18:1, 19:1, 20:1, 21:1, 22:1, 23:1, 24:1, 25:1, 26:1, 27:1, 28:1, 29:1, 30:1, 31:1, 32:1, 33:1, 34:1, 35:1, 36:1, 37:1, 38:1, 39:1, 40:1, 41:1, 42:1, 43:1, 44:1, 45:1, 46:1, 47:1, 48:1, 49:1, 50:1, 51:1, 52:1, 53:1, 54:1, 55:1, 56:1, 57:1, 58:1, 59:1 or 60:1 (wt/wt). In some embodiments, the wt/wt ratio of the lipid composition to the polynucleotide encoding a therapeutic agent is about 20:1 or about 15:1.

In some embodiments, the pharmaceutical composition disclosed herein can contain more than one polypeptides. For example, a pharmaceutical composition disclosed herein can contain two or more polynucleotides (e.g., RNA, e.g., mRNA).

In one embodiment, the lipid nanoparticles described herein can comprise polynucleotides (e.g., mRNA) in a lipid:polynucleotide weight ratio of 5:1, 10:1, 15:1, 20:1, 25:1, 30:1, 35:1, 40:1, 45:1, 50:1, 55:1, 60:1 or 70:1, or a range or any of these ratios such as, but not limited to, 5:1 to about 10:1, from about 5:1 to about 15:1, from about 5:1 to about 20:1, from about 5:1 to about 25:1, from about 5:1 to about 30:1, from about 5:1 to about 35:1, from about 5:1 to about 40:1, from about 5:1 to about 45:1, from about 5:1 to about 50:1, from about 5:1 to about 55:1, from about 5:1 to about 60:1, from about 5:1 to about 70:1, from about 10:1 to about 15:1, from about 10:1 to about 20:1, from about 10:1 to about 25:1, from about 10:1 to about 30:1, from about 10:1 to about 35:1, from about 10:1 to about 40:1, from about 10:1 to about 45:1, from about 10:1 to about 50:1, from about 10:1 to about 55:1, from about 10:1 to about 60:1, from about 10:1 to about 70:1, from about 15:1 to about 20:1, from about 15:1 to about 25:1, from about 15:1 to about 30:1, from about 15:1 to about 35:1, from about 15:1 to about 40:1, from about 15:1 to about 45:1, from about 15:1 to about 50:1, from about 15:1 to about 55:1, from about 15:1 to about 60:1 or from about 15:1 to about 70:1.

In one embodiment, the lipid nanoparticles described herein can comprise the polynucleotide in a concentration from approximately 0.1 mg/ml to 2 mg/ml such as, but not limited to, 0.1 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.1 mg/ml, 1.2 mg/ml, 1.3 mg/ml, 1.4 mg/ml, 1.5 mg/ml, 1.6 mg/ml, 1.7 mg/ml, 1.8 mg/ml, 1.9 mg/ml, 2.0 mg/ml or greater than 2.0 mg/ml.

In one embodiment, formulations comprising the polynucleotides and lipid nanoparticles described herein can comprise 0.15 mg/ml to 2 mg/ml of the polynucleotide described herein (e.g., mRNA). In some embodiments, the formulation can further comprise 10 mM of citrate buffer and the formulation can additionally comprise up to 10% w/w of sucrose (e.g., at least 1% w/w, at least 2% w/w/, at least 3% w/w, at least 4% w/w, at least 5% w/w, at least 6% w/w, at least 7% w/w, at least 8% w/w, at least 9% w/w or 10% w/w).

(vii) Nanoparticle Compositions

In some embodiments, the pharmaceutical compositions disclosed herein are formulated as lipid nanoparticles (LNP). Accordingly, the present disclosure also provides nanoparticle compositions comprising (i) a lipid composition comprising a compound of formula (I) as described herein, and (ii) a polynucleotide encoding an MCM polypeptide. In such nanoparticle composition, the lipid composition disclosed herein can encapsulate the polynucleotide encoding an MCM polypeptide.

Nanoparticle compositions are typically sized on the order of micrometers or smaller and can include a lipid bilayer. Nanoparticle compositions encompass lipid nanoparticles (LNPs), liposomes (e.g., lipid vesicles), and lipoplexes. For example, a nanoparticle composition can be a liposome having a lipid bilayer with a diameter of 500 nm or less.

Nanoparticle compositions include, for example, lipid nanoparticles (LNPs), liposomes, and lipoplexes. In some embodiments, nanoparticle compositions are vesicles including one or more lipid bilayers. In certain embodiments, a nanoparticle composition includes two or more concentric bilayers separated by aqueous compartments. Lipid bilayers can be functionalized and/or crosslinked to one another. Lipid bilayers can include one or more ligands, proteins, or channels.

Nanoparticle compositions of the present disclosure comprise at least one compound according to formula (I). For example, the nanoparticle composition can include one or more of Compounds 1-147. Nanoparticle compositions can also include a variety of other components. For example, the nanoparticle composition can include one or more other lipids in addition to a lipid according to formula (I) or (II), for example (i) at least one phospholipid, (ii) at least one quaternary amine compound, (iii) at least one structural lipid, (iv) at least one PEG-lipid, or (v) any combination thereof.

In some embodiments, the nanoparticle composition comprises a compound of formula (I), (e.g., Compounds 18, 25, 26 or 48). In some embodiments, the nanoparticle composition comprises a compound of formula (I) (e.g., Compounds 18, 25, 26 or 48) and a phospholipid (e.g., DSPC or MSPC). In some embodiments, the nanoparticle composition comprises a compound of formula (I) (e.g., Compounds 18, 25, 26 or 48), a phospholipid (e.g., DSPC or MSPC), and a quaternary amine compound (e.g., DOTAP). In some embodiments, the nanoparticle composition comprises a compound of formula (I) (e.g., Compounds 18, 25, 26 or 48), and a quaternary amine compound (e.g., DOTAP).

In some embodiments, the nanoparticle composition comprises a lipid composition consisting or consisting essentially of compound of formula (I) (e.g., Compounds 18, 25, 26 or 48). In some embodiments, the nanoparticle composition comprises a lipid composition consisting or consisting essentially of a compound of formula (I) (e.g., Compounds 18, 25, 26 or 48) and a phospholipid (e.g., DSPC or MSPC). In some embodiments, the nanoparticle composition comprises a lipid composition consisting or consisting essentially of a compound of formula (I) (e.g., Compounds 18, 25, 26 or 48), a phospholipid (e.g., DSPC or MSPC), and a quaternary amine compound (e.g., DOTAP). In some embodiments, the nanoparticle composition comprises a lipid composition consisting or consisting essentially of a compound of formula (I) (e.g., Compounds 18, 25, 26 or 48), and a quaternary amine compound (e.g., DOTAP).

Nanoparticle compositions can be characterized by a variety of methods. For example, microscopy (e.g., transmission electron microscopy or scanning electron microscopy) can be used to examine the morphology and size distribution of a nanoparticle composition. Dynamic light scattering or potentiometry (e.g., potentiometric titrations) can be used to measure zeta potentials. Dynamic light scattering can also be utilized to determine particle sizes. Instruments such as the Zetasizer Nano ZS (Malvern Instruments Ltd, Malvern, Worcestershire, UK) can also be used to measure multiple characteristics of a nanoparticle composition, such as particle size, polydispersity index, and zeta potential.

The size of the nanoparticles can help counter biological reactions such as, but not limited to, inflammation, or can increase the biological effect of the polynucleotide.

As used herein, "size" or "mean size" in the context of nanoparticle compositions refers to the mean diameter of a nanoparticle composition.

In one embodiment, the polynucleotide encoding an MCM polypeptide are formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm, about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the nanoparticles have a diameter from about 10 to 500 nm. In one embodiment, the nanoparticle has a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the largest dimension of a nanoparticle composition is 1 μm or shorter (e.g., 1 μm, 900 nm, 800 nm, 700 nm, 600 nm, 500 nm, 400 nm, 300 nm, 200 nm, 175 nm, 150 nm, 125 nm, 100 nm, 75 nm, 50 nm, or shorter).

A nanoparticle composition can be relatively homogenous. A polydispersity index can be used to indicate the homogeneity of a nanoparticle composition, e.g., the particle size distribution of the nanoparticle composition. A small (e.g., less than 0.3) polydispersity index generally indicates a narrow particle size distribution. A nanoparticle composition can have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a nanoparticle composition disclosed herein can be from about 0.10 to about 0.20.

The zeta potential of a nanoparticle composition can be used to indicate the electrokinetic potential of the composition. For example, the zeta potential can describe the surface charge of a nanoparticle composition. Nanoparticle compositions with relatively low charges, positive or negative, are generally desirable, as more highly charged species can interact undesirably with cells, tissues, and other elements in the body. In some embodiments, the zeta potential of a nanoparticle composition disclosed herein can be from about −10 mV to about +20 mV, from about −10 mV to about +15 mV, from about 10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

In some embodiments, the zeta potential of the lipid nanoparticles can be from about 0 mV to about 100 mV, from about 0 mV to about 90 mV, from about 0 mV to about 80 mV, from about 0 mV to about 70 mV, from about 0 mV to about 60 mV, from about 0 mV to about 50 mV, from about 0 mV to about 40 mV, from about 0 mV to about 30 mV, from about 0 mV to about 20 mV, from about 0 mV to about 10 mV, from about 10 mV to about 100 mV, from about 10 mV to about 90 mV, from about 10 mV to about 80 mV, from about 10 mV to about 70 mV, from about 10 mV to about 60 mV, from about 10 mV to about 50 mV, from about 10 mV to about 40 mV, from about 10 mV to about 30 mV, from about 10 mV to about 20 mV, from about 20 mV to about 100 mV, from about 20 mV to about 90 mV, from about 20 mV to about 80 mV, from about 20 mV to about 70 mV, from about 20 mV to about 60 mV, from about 20 mV to about 50 mV, from about 20 mV to about 40 mV, from about 20 mV to about 30 mV, from about 30 mV to about 100 mV, from about 30 mV to about 90 mV, from about 30 mV to about 80 mV, from about 30 mV to about 70 mV, from about 30 mV to about 60 mV, from about 30 mV to about 50 mV, from about 30 mV to about 40 mV, from about 40 mV to about 100 mV, from about 40 mV to about 90 mV, from about 40 mV to about 80 mV, from about 40 mV to about 70 mV, from about 40 mV to about 60 mV, and from about 40 mV to about 50 mV. In some embodiments, the zeta potential of the lipid nanoparticles can be from about 10 mV to about 50 mV, from about 15 mV to about 45 mV, from about 20 mV to about 40 mV, and from about 25 mV to about 35 mV. In some embodiments, the zeta potential of the lipid nanoparticles can be about 10 mV, about 20 mV, about 30 mV, about 40 mV, about 50 mV, about 60 mV, about 70 mV, about 80 mV, about 90 mV, and about 100 mV.

The term "encapsulation efficiency" of a polynucleotide describes the amount of the polynucleotide that is encapsulated by or otherwise associated with a nanoparticle composition after preparation, relative to the initial amount provided. As used herein, "encapsulation" can refer to complete, substantial, or partial enclosure, confinement, surrounding, or encasement.

Encapsulation efficiency is desirably high (e.g., close to 100%). The encapsulation efficiency can be measured, for example, by comparing the amount of the polynucleotide in a solution containing the nanoparticle composition before and after breaking up the nanoparticle composition with one or more organic solvents or detergents.

Fluorescence can be used to measure the amount of free polynucleotide in a solution. For the nanoparticle compositions described herein, the encapsulation efficiency of a polynucleotide can be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency can be at least 80%. In certain embodiments, the encapsulation efficiency can be at least 90%.

The amount of a polynucleotide present in a pharmaceutical composition disclosed herein can depend on multiple factors such as the size of the polynucleotide, desired target and/or application, or other properties of the nanoparticle composition as well as on the properties of the polynucleotide.

For example, the amount of an mRNA useful in a nanoparticle composition can depend on the size (expressed as length, or molecular mass), sequence, and other characteristics of the mRNA. The relative amounts of a polynucleotide in a nanoparticle composition can also vary.

The relative amounts of the lipid composition and the polynucleotide present in a lipid nanoparticle composition of the present disclosure can be optimized according to considerations of efficacy and tolerability. For compositions including an mRNA as a polynucleotide, the N:P ratio can serve as a useful metric.

As the N:P ratio of a nanoparticle composition controls both expression and tolerability, nanoparticle compositions with low N:P ratios and strong expression are desirable. N:P ratios vary according to the ratio of lipids to RNA in a nanoparticle composition.

In general, a lower N:P ratio is preferred. The one or more RNA, lipids, and amounts thereof can be selected to provide an N:P ratio from about 2:1 to about 30:1, such as 2:1, 3:1, 4:1, 5:1, 6:1, 7:1, 8:1, 9:1, 10:1, 12:1, 14:1, 16:1, 18:1, 20:1, 22:1, 24:1, 26:1, 28:1, or 30:1. In certain embodiments, the N:P ratio can be from about 2:1 to about 8:1. In other embodiments, the N:P ratio is from about 5:1 to about 8:1. In certain embodiments, the N:P ratio is between 5:1 and 6:1. In one specific aspect, the N:P ratio is about is about 5.67:1.

In addition to providing nanoparticle compositions, the present disclosure also provides methods of producing lipid nanoparticles comprising encapsulating a polynucleotide. Such method comprises using any of the pharmaceutical compositions disclosed herein and producing lipid nanoparticles in accordance with methods of production of lipid nanoparticles known in the art. See, e.g., Wang et al. (2015) "Delivery of oligonucleotides with lipid nanoparticles" Adv. Drug Deliv. Rev. 87:68-80; Silva et al. (2015) "Delivery Systems for Biopharmaceuticals. Part I: Nanoparticles and Microparticles" Curr. Pharm. Technol. 16: 940-954; Naseri et al. (2015) "Solid Lipid Nanoparticles and Nanostructured Lipid Carriers: Structure, Preparation and Application" Adv. Pharm. Bull. 5:305-13; Silva et al. (2015) "Lipid nanoparticles for the delivery of biopharmaceuticals" Curr. Pharm. Biotechnol. 16:291-302, and references cited therein.

Excipients

The disclosure also includes pharmaceutical compositions that comprise a formulation of a polynucleotide described herein, i.e., a polynucleotide comprising an ORF encoding an MCM polypeptide, with excipients. The polynucleotides of the disclosure can be formulated using one or more excipients to: (1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present disclosure can include, without limitation, lipidoids, liposomes, lipid nanoparticles, polymers, lipoplexes, core-shell nanoparticles, peptides, proteins, cells transfected with polynucleotides (e.g., for transplantation into a subject), hyaluronidase, nanoparticle mimics and combinations thereof. Accordingly, the formulations of the disclosure can include one or more excipients, each in an amount that together increases the stability of the polynucleotide, increases cell transfection by the polynucleotide, increases the expression of polynucleotides encoded protein, and/or alters the release profile of polynucleotide encoded proteins. Further, the polynucleotides of the present disclosure can be formulated using self-assembled nucleic acid nanoparticles.

A pharmaceutically acceptable excipient, as used herein, includes, but are not limited to, any and all solvents, dispersion media, diluents, or other liquid vehicles, dispersion or suspension aids, surface active agents, isotonic agents, thickening or emulsifying agents, preservatives, solid binders, lubricants, flavoring agents, stabilizers, antioxidants, osmolality adjusting agents, pH adjusting agents and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro (Lippincott, Williams & Wilkins, Baltimore, Md., 2006; incorporated herein by reference in its entirety). The use of a conventional excipient medium can be contemplated within the scope of the present disclosure, except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

In some embodiments, a pharmaceutically acceptable excipient can be at least 95%, at least 96%, at least 97%, at least 98%, at least 99%, or 100% pure. In some embodiments, an excipient is approved for use for humans and for veterinary use. In some embodiments, an excipient can be approved by United States Food and Drug Administration. In some embodiments, an excipient can be of pharmaceutical grade. In some embodiments, an excipient can meet the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients can optionally be included in pharmaceutical compositions. The composition can also include excipients such as cocoa butter and suppository waxes, coloring agents, coating agents, sweetening, flavoring, and/or perfuming agents.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g., bentonite [aluminum silicate] and VEEGUM® [magnesium aluminum silicate]), long chain amino acid derivatives, high molecular weight alcohols (e.g., stearyl alcohol, cetyl alcohol, oleyl alcohol, triacetin monostearate, ethylene glycol distearate, glyceryl monostearate, and propylene glycol monostearate, polyvinyl alcohol), carbomers (e.g., carboxy polymethylene, polyacrylic acid, acrylic acid polymer, and carboxyvinyl polymer), carrageenan, cellulosic derivatives (e.g., carboxymethylcellulose sodium, powdered cellulose, hydroxymethyl cellulose, hydroxypropyl cellulose, hydroxypropyl methylcellulose, methylcellulose), sorbitan fatty acid esters (e.g., polyoxyethylene sorbitan monolaurate [TWEEN®20], polyoxyethylene sorbitan [TWEEN®60], polyoxyethylene sorbitan monooleate [TWEEN®80], sorbitan monopalmitate [SPAN®40], sorbitan monostearate [SPAN®60], sorbitan tristearate [SPAN®65], glyceryl monooleate, sorbitan monooleate [SPAN®80]), polyoxyethylene esters (e.g., polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g., CREMOPHOR®), polyoxyethylene ethers, (e.g., polyoxyethylene lauryl ether [BRIJ®30]), poly(vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC® F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g., cornstarch and starch paste); gelatin; sugars (e.g., sucrose, glucose, dextrose, dextrin, molasses, lactose, lactitol, mannitol); amino acids (e.g., glycine); natural and synthetic gums (e.g., acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (VEEGUM®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives can include, but are not limited to, antioxidants, chelating agents, antimicrobial preservatives, antifungal preservatives, alcohol preservatives, acidic preservatives, and/or other preservatives. Oxidation is a potential degradation pathway for mRNA, especially for liquid mRNA formulations. In order to prevent oxidation, antioxidants can be added to the formulation. Exemplary antioxidants include, but are not limited to, alpha tocopherol, ascorbic acid, acorbyl palmitate, benzyl alcohol, butylated hydroxyanisole, EDTA, m-cresol, methionine, butylated hydroxytoluene, monothioglycerol, potassium metabisulfite, propionic acid, propyl gallate, sodium ascorbate, sodium bisulfite, sodium metabisulfite, thioglycerol and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL® 15, GERMABEN® II, NEOLONE™, KATHON™, and/or EUXYL®.

In some embodiments, the pH of polynucleotide solutions are maintained between pH 5 and pH 8 to improve stability. Exemplary buffers to control pH can include, but are not limited to sodium phosphate, sodium citrate, sodium succinate, histidine (or histidine-HCl), sodium carbonate, and/or sodium malate. In another embodiment, the exemplary buffers listed above can be used with additional monovalent counterions (including, but not limited to potassium). Divalent cations can also be used as buffer counterions; however, these are subject to complex formation and/or mRNA degradation.

Exemplary buffering agents can also include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, *eucalyptus*, evening primrose, fish, flaxseed, geraniol, gourd, grape seed, hazel nut, hyssop, isopropyl myristate, jojoba, kukui nut, lavandin, lavender, lemon, *litsea cubeba*, macadamia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Exemplary additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Lipidoids

The disclosure includes pharmaceutical compositions that comprise a lipidoid formulation of the polynucleotide described herein, i.e., a polynucleotide comprising an ORF encoding an MCM polypeptide.

The synthesis of lipidoids has been extensively described and formulations containing these compounds are particularly suited for delivery of polynucleotides (see Mahon et al., Bioconjug. Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

Lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010; all of which is incorporated herein in their entirety), and the present disclosure describes their formulation and use in delivering polynucleotides.

Complexes, micelles, liposomes or particles can be prepared containing these lipidoids and therefore, can result in an effective delivery of the polynucleotide, as judged by the production of an encoded protein, following the injection of a lipidoid formulation via localized and/or systemic routes of administration. Lipidoid complexes of polynucleotides can be administered by various means including, but not limited to, intravenous, intramuscular, or subcutaneous routes.

In vivo delivery of nucleic acids can be affected by many parameters, including, but not limited to, the formulation composition, nature of particle PEGylation, degree of loading, polynucleotide to lipid ratio, and biophysical parameters such as, but not limited to, particle size (Akinc et al., Mol Ther. 2009 17:872-879; herein incorporated by reference in its entirety). As an example, small changes in the anchor chain length of poly(ethylene glycol) (PEG) lipids can result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010); herein incorporated by reference in its entirety), C12-200 (including derivatives and variants), and MD1, can be tested for in vivo activity.

The lipidoid referred to herein as "98N12-5" is disclosed by Akinc et al., Mol Ther. 2009 17:872-879 and is incorporated by reference in its entirety.

The lipidoid referred to herein as "C12-200" is disclosed by Love et al., Proc Natl Acad Sci USA. 2010 107:1864-1869 and Liu and Huang, Molecular Therapy. 2010 669-670; both of which are herein incorporated by reference in their entirety. The lipidoid formulations can include particles comprising either 3 or 4 or more components in addition to polynucleotides.

Lipidoids and polynucleotide formulations comprising lipidoids are described in International Patent Application No. PCT/US2014/097077, the contents of which are herein incorporated by reference in its entirety.

Liposomes, Lipoplexes, and Lipid Nanoparticles

The disclosure also includes pharmaceutical compositions that comprise a formulation of the polynucleotide described herein, i.e., a polynucleotide comprising an ORF encoding an MCM polypeptide, using one or more liposomes, lipoplexes, or lipid nanoparticles. In one embodiment, pharmaceutical compositions of the polynucleotides include liposomes. Liposomes are artificially-prepared vesicles that can primarily be composed of a lipid bilayer and can be used as a delivery vehicle for the administration of nutrients and pharmaceutical formulations. Liposomes can be of different sizes such as, but not limited to, a multilamellar vesicle (MLV) that can be hundreds of nanometers in diameter and can contain a series of concentric bilayers separated by narrow aqueous compartments, a small unicellular vesicle (SUV) that can be smaller than 50 nm in diameter, and a large unilamellar vesicle (LUV) that can be between 50 and 500 nm in diameter. Liposome design can include, but is not limited to, opsonins or ligands in order to improve the attachment of liposomes to unhealthy tissue or to activate events such as, but not limited to, endocytosis. Liposomes can contain a low or a high pH in order to improve the delivery of the pharmaceutical formulations.

The formation of liposomes can depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

As a non-limiting example, liposomes such as synthetic membrane vesicles can be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety.

In one embodiment, pharmaceutical compositions described herein can include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes that can deliver small molecule drugs such as, but not limited to, DOXIL® from Janssen Biotech, Inc. (Horsham, Pa.).

In one embodiment, pharmaceutical compositions described herein can include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication No US20130122104; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations can contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations can comprise from about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. For example, formulations can comprise a percentage of cholesterol selected from the group consisting of 28.5%, 31.5%, 33.5%, 36.5%, 37.0%, 38.5%, 39.0% and 43.5%. In some embodiments, formulations can comprise from about 5.0% to about 10.0% DSPC and/or from about 7.0% to about 15.0% DSPC.

In one embodiment, pharmaceutical compositions can include liposomes that can be formed to deliver polynucleotides that can encode at least one polypeptide of interest. The polynucleotides can be encapsulated by the liposome and/or it can be contained in an aqueous core that can then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In another embodiment, liposomes can be formulated for targeted delivery. As a non-limiting example, the liposome can be formulated for targeted delivery to the liver. The liposome used for targeted delivery can include, but is not limited to, the liposomes described in and methods of making liposomes described in US Patent Publication No.

US20130195967, the contents of which are herein incorporated by reference in its entirety.

In another embodiment, the polynucleotide can be formulated in a cationic oil-in-water emulsion where the emulsion particle comprises an oil core and a cationic lipid that can interact with the polynucleotide anchoring the molecule to the emulsion particle (see International Pub. No. WO2012006380; herein incorporated by reference in its entirety).

In one embodiment, the polynucleotides can be formulated in a water-in-oil emulsion comprising a continuous hydrophobic phase in which the hydrophilic phase is dispersed. As a non-limiting example, the emulsion can be made by the methods described in International Publication No. WO201087791, the contents of which are herein incorporated by reference in its entirety.

In another embodiment, the lipid formulation can include at least cationic lipid, a lipid that can enhance transfection and a least one lipid that contains a hydrophilic head group linked to a lipid moiety (International Pub. No. WO2011076807 and U.S. Pub. No. 20110200582; the contents of each of which is herein incorporated by reference in their entirety). In another embodiment, the polynucleotides can be formulated in a lipid vesicle that can have crosslinks between functionalized lipid bilayers (see U.S. Pub. No. 20120177724, the contents of which is herein incorporated by reference in its entirety).

In one embodiment, the polynucleotides can be formulated in a liposome as described in International Patent Publication No. WO2013086526, the contents of which is herein incorporated by reference in its entirety. The polynucleotides can be encapsulated in a liposome using reverse pH gradients and/or optimized internal buffer compositions as described in International Patent Publication No. WO2013086526, the contents of which is herein incorporated by reference in its entirety.

In one embodiment, the polynucleotides pharmaceutical compositions can be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the cationic lipid can be a low molecular weight cationic lipid such as those described in US Patent Application No. 20130090372, the contents of which are herein incorporated by reference in its entirety.

In one embodiment, the polynucleotides can be formulated in a lipid vesicle that can have crosslinks between functionalized lipid bilayers.

In one embodiment, the polynucleotides can be formulated in a liposome comprising a cationic lipid. The liposome can have a molar ratio of nitrogen atoms in the cationic lipid to the phosphates in the RNA (N:P ratio) of between 1:1 and 20:1 as described in International Publication No. WO2013006825, herein incorporated by reference in its entirety. In another embodiment, the liposome can have a N:P ratio of greater than 20:1 or less than 1:1.

In one embodiment, the polynucleotides can be formulated in a lipid-polycation complex. The formation of the lipid-polycation complex can be accomplished by methods known in the art and/or as described in U.S. Pub. No. 20120178702, herein incorporated by reference in its entirety. As a non-limiting example, the polycation can include a cationic peptide or a polypeptide such as, but not limited to, polylysine, polyornithine and/or polyarginine and the cationic peptides described in International Pub. No. WO2012013326 or US Patent Pub. No. US20130142818; each of which is herein incorporated by reference in its entirety. In another embodiment, the polynucleotides can be formulated in a lipid-polycation complex that can further include a non-cationic lipid such as, but not limited to, cholesterol or dioleoyl phosphatidylethanolamine (DOPE).

In one embodiment, the polynucleotides can be formulated in an aminoalcohol lipidoid. Aminoalcohol lipidoids that can be used in the present disclosure can be prepared by the methods described in U.S. Pat. No. 8,450,298, herein incorporated by reference in its entirety.

The liposome formulation can be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety). In some embodiments, liposome formulations can comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes can be from about 5:1 to about 20:1, from about 10:1 to about 25:1, from about 15:1 to about 30:1 and/or at least 30:1.

In some embodiments, the ratio of PEG in the lipid nanoparticle (LNP) formulations can be increased or decreased and/or the carbon chain length of the PEG lipid can be modified from C14 to C18 to alter the pharmacokinetics and/or biodistribution of the LNP formulations. As a non-limiting example, LNP formulations can contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[(ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In another embodiment the PEG-c-DOMG can be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid can be selected from any lipid known in the art such as, but not limited to, DLin-MC3-DMA, DLin-DMA, C12-200 and DLin-KC2-DMA.

In one embodiment, the polynucleotides can be formulated in a lipid nanoparticle such as those described in International Publication No. WO2012170930, the contents of which is herein incorporated by reference in its entirety.

In one embodiment, the formulation comprising the polynucleotide is a nanoparticle that can comprise at least one lipid. The lipid can be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid can be a cationic lipid such as, but not limited to, DLin-DMA, DLin-D-DMA, DLin-MC3-DMA, DLin-KC2-DMA, DODMA and amino alcohol lipids. The amino alcohol cationic lipid can be the lipids described in and/or made by the methods described in US Patent Publication No. US20130150625, herein incorporated by reference in its entirety. As a non-limiting example, the cationic lipid can be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In one embodiment, the lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of about 20-60% cationic lipid:5-25% neutral lipid:25-55% sterol; 0.5-15% PEG-lipid.

In one embodiment, the formulation includes from about 25% to about 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), e.g., from about 35 to about 65%, from about 45 to about 65%, about 60%, about 57.5%, about 50% or about 40% on a molar basis.

In one embodiment, the formulation includes from about 0.5% to about 15% on a molar basis of the neutral lipid e.g., from about 3 to about 12%, from about 5 to about 10% or about 15%, about 10%, or about 7.5% on a molar basis. Exemplary neutral lipids include, but are not limited to, DSPC, POPC, DPPC, DOPE and SM. In one embodiment, the formulation includes from about 5% to about 50% on a molar basis of the sterol (e.g., about 15 to about 45%, about 20 to about 40%, about 40%, about 38.5%, about 35%, or about 31% on a molar basis. An exemplary sterol is cholesterol. In one embodiment, the formulation includes from about 0.5% to about 20% on a molar basis of the PEG or PEG-modified lipid (e.g., about 0.5 to about 10%, about 0.5 to about 5%, about 1.5%, about 0.5%, about 1.5%, about 3.5%, or about 5% on a molar basis. In one embodiment, the PEG or PEG modified lipid comprises a PEG molecule of an average molecular weight of 2,000 Da. In other embodiments, the PEG or PEG modified lipid comprises a PEG molecule of an average molecular weight of less than 2,000, for example around 1,500 Da, around 1,000 Da, or around 500 Da. Exemplary PEG-modified lipids include, but are not limited to, PEG-distearoyl glycerol (PEG-DMG) (also referred herein as PEG-C14 or C14-PEG), PEG-cDMA (further discussed in Reyes et al. J. Controlled Release, 107, 276-287 (2005) the contents of which are herein incorporated by reference in its entirety)

In one embodiment, the formulations of the disclosure include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In one embodiment, the formulations of the disclosure include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In one embodiment, the formulations of the disclosure include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In one embodiment, the formulations of the disclosure include about 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.5% of the neutral lipid, about 31% of the sterol, and about 1.5% of the PEG or PEG-modified lipid on a molar basis.

In one embodiment, the formulations of the disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 38.5% of the sterol, and about 1.5% of the PEG or PEG-modified lipid on a molar basis.

In one embodiment, the formulations of the disclosure include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 35% of the sterol, about 4.5% or about 5% of the PEG or PEG-modified lipid, and about 0.5% of the targeting lipid on a molar basis.

In one embodiment, the formulations of the disclosure include about 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 15% of the neutral lipid, about 40% of the sterol, and about 5% of the PEG or PEG-modified lipid on a molar basis.

In one embodiment, the formulations of the disclosure include about 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.1% of the neutral lipid, about 34.3% of the sterol, and about 1.4% of the PEG or PEG-modified lipid on a molar basis.

In one embodiment, the formulations of the disclosure include about 57.5% of a cationic lipid selected from the PEG lipid is PEG-cDMA (PEG-cDMA is further discussed in Reyes et al. (J. Controlled Release, 107, 276-287 (2005), the contents of which are herein incorporated by reference in its entirety), about 7.5% of the neutral lipid, about 31.5% of the sterol, and about 3.5% of the PEG or PEG-modified lipid on a molar basis.

In some embodiments, lipid nanoparticle formulation consists essentially of a lipid mixture in molar ratios of about 20-70% cationic lipid: 5-45% neutral lipid: 20-55% cholesterol: 0.5-15% PEG-modified lipid. In some embodiments, lipid nanoparticle formulation consists essentially of a lipid mixture in molar ratios of about 20-60% cationic lipid: 5-25% neutral lipid: 25-55% cholesterol: 0.5-15% PEG-modified lipid.

In particular embodiments, the molar lipid ratio is approximately 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Exemplary lipid nanoparticle compositions and methods of making same are described, for example, in Semple et al. (2010) Nat. Biotechnol. 28:172-176; Jayarama et al. (2012), Angew. Chem. Int. Ed., 51: 8529-8533; and Maier et al. (2013) Molecular Therapy 21, 1570-1578 (the contents of each of which are incorporated herein by reference in their entirety).

In one embodiment, the lipid nanoparticle formulations described herein can comprise a cationic lipid, a PEG lipid and a structural lipid and optionally comprise a non-cationic lipid. As a non-limiting example, the lipid nanoparticle can comprise about 40-60% of cationic lipid, about 5-15% of a non-cationic lipid, about 1-2% of a PEG lipid and about 30-50% of a structural lipid. As another non-limiting example, the lipid nanoparticle can comprise about 50% cationic lipid, about 10% non-cationic lipid, about 1.5% PEG lipid and about 38.5% structural lipid. As yet another non-limiting example, the lipid nanoparticle can comprise about 55% cationic lipid, about 10% non-cationic lipid, about 2.5% PEG lipid and about 32.5% structural lipid. In one embodiment, the cationic lipid can be any cationic lipid described herein such as, but not limited to, DLin-KC2-DMA, DLin-MC3-DMA and L319.

In one embodiment, the lipid nanoparticle formulations described herein can be 4 component lipid nanoparticles. The lipid nanoparticle can comprise a cationic lipid, a non-cationic lipid, a PEG lipid and a structural lipid. As a non-limiting example, the lipid nanoparticle can comprise about 40-60% of cationic lipid, about 5-15% of a non-cationic lipid, about 1-2% of a PEG lipid and about 30-50% of a structural lipid. As another non-limiting example, the lipid nanoparticle can comprise about 50% cationic lipid, about 10% non-cationic lipid, about 1.5% PEG lipid and about 38.5% structural lipid. As yet another non-limiting example, the lipid nanoparticle can comprise about 55% cationic lipid, about 10% non-cationic lipid, about 2.5% PEG lipid and about 32.5% structural lipid. In one embodiment, the cationic lipid can be any cationic lipid described herein such as, but not limited to, DLin-KC2-DMA, DLin-MC3-DMA and L319.

In one embodiment, the lipid nanoparticle formulations described herein can comprise a cationic lipid, a non-cationic lipid, a PEG lipid and a structural lipid. As a non-limiting example, the lipid nanoparticle comprise about 50% of the cationic lipid DLin-KC2-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DMG and about 38.5% of the structural lipid cholesterol. As yet another non-limiting example, the lipid nanoparticle comprise about 55% of the cationic lipid L319, about 10% of the non-cationic lipid DSPC, about 2.5% of the PEG lipid PEG-DMG and about 32.5% of the structural lipid cholesterol.

In one embodiment, the cationic lipid can be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865, WO2008103276, WO2013086373 and WO2013086354, U.S. Pat. Nos. 7,893,302, 7,404,969, 8,283,333, and 8,466,122 and US Patent Publication No. US20100036115, US20120202871, US20130064894, US20130129785, US20130150625, US20130178541 and US20130225836; the contents of each of which are herein incorporated by reference in their entirety. In another embodiment, the cationic lipid can be selected from, but not limited to, formula A described in International Publication Nos. WO2012040184, WO2011153120, WO2011149733, WO2011090965, WO2011043913, WO2011022460, WO2012061259, WO2012054365, WO2012044638 and WO2013116126 or US Patent Publication No. US20130178541 and US20130225836; the contents of each of which is herein incorporated by reference in their entirety. In yet another embodiment, the cationic lipid can be selected from, but not limited to, formula CLI-CLXXIX of International Publication No. WO2008103276, formula CLI-CLXXIX of U.S. Pat. No. 7,893,302, formula CLI-CLXXXII of U.S. Pat. No. 7,404,969 and formula I-VI of US Patent Publication No. US20100036115, formula I of US Patent Publication No US20130123338; each of which is herein incorporated by reference in their entirety. As a non-limiting example, the cationic lipid can be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-1 6, 19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21 Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21 Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl] pyrrolidine, (20Z)—N,N-dimethylheptacos-20-en-10-amine, (15Z)—N,N-dimethyleptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine,N,N-dimethyl-1-[(1 S,2S)-2-{[(1R,2R)-2-pentylcyclopropyl]methyl}cyclopropyl]nonadecan-10-amine,N,N-dimethyl-1-[(1 S,2R)-2-octylcyclopropyl]hexadecan-8-amine, N,N-dimethyl-[(1R,2 S)-2-undecyIcyclopropyl]tetradecan-5-amine, N,N-dimethyl-3-{7-[(1 S,2R)-2-octylcyclopropyl]heptyl}dodecan-1-amine, 1-[(1R,2S)-2-heptylcyclopropyl]-N,N-dimethyloctadecan-9-amine, 1-[(1 S,2R)-2-decylcyclopropyl]-N,N-dimethylpentadecan-6-amine, N,N-dimethyl-1-[(1 S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2 S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In one embodiment, the lipid can be a cleavable lipid such as those described in International Publication No. WO2012170889, herein incorporated by reference in its entirety.

In another embodiment, the lipid can be a cationic lipid such as, but not limited to, Formula (I) of U.S. Patent Application No. US20130064894, the contents of which are herein incorporated by reference in its entirety.

In one embodiment, the cationic lipid can be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724, WO201021865, WO2013086373 and WO2013086354; the contents of each of which are herein incorporated by reference in their entirety.

In another embodiment, the cationic lipid can be a trialkyl cationic lipid. Non-limiting examples of trialkyl cationic lipids and methods of making and using the trialkyl cationic lipids are described in International Patent Publication No. WO2013126803, the contents of which are herein incorporated by reference in its entirety.

In one embodiment, the LNP formulations of the polynucleotides can contain PEG-c-DOMG at 3% lipid molar ratio. In another embodiment, the LNP formulations of polynucleotides can contain PEG-c-DOMG at 1.5% lipid molar ratio.

In another embodiment, the pharmaceutical compositions of the polynucleotides can include at least one of the PEGylated lipids described in International Publication No. WO2012099755, the contents of which is herein incorporated by reference in its entirety.

In one embodiment, the LNP formulation can contain PEG-DMG 2000 (1,2-dimyristoyl-sn-glycero-3-phophoethanolamine-N-[methoxy(polyethylene glycol)-2000). In one embodiment, the LNP formulation can contain PEG-DMG 2000, a cationic lipid known in the art and at least one other component. In another embodiment, the LNP formulation can contain PEG-DMG 2000, a cationic lipid known in the art, DSPC and cholesterol. As a non-limiting example, the LNP formulation can contain PEG-DMG 2000, DLin-DMA, DSPC and cholesterol. As another non-limiting example the LNP formulation can contain PEG-DMG 2000, DLin-DMA, DSPC and cholesterol in a molar ratio of 2:40:10:48 (see, e.g., Geall et al., Nonviral delivery of self-amplifying RNA vaccines, PNAS 2012; PMID: 22908294; herein incorporated by reference in its entirety).

In one embodiment, the LNP formulation can be formulated by the methods described in International Publication Nos. WO2011127255 or WO2008103276, the contents of each of which is herein incorporated by reference in their entirety. As a non-limiting example, the polynucleotides described herein can be encapsulated in LNP formulations as described in WO2011127255 and/or WO2008103276; each of which is herein incorporated by reference in their entirety.

In one embodiment, the polynucleotides described herein can be formulated in a nanoparticle to be delivered by a parenteral route as described in U.S. Pub. No. US20120207845; the contents of which are herein incorporated by reference in its entirety.

In one embodiment, the Polynucleotides can be formulated in a lipid nanoparticle made by the methods described in US Patent Publication No US20130156845 or International Publication No WO2013093648 or WO2012024526, each of which is herein incorporated by reference in its entirety.

The lipid nanoparticles described herein can be made in a sterile environment by the system and/or methods described in US Patent Publication No. US20130164400, herein incorporated by reference in its entirety.

In one embodiment, the LNP formulation can be formulated in a nanoparticle such as a nucleic acid-lipid particle described in U.S. Pat. No. 8,492,359, the contents of which are herein incorporated by reference in its entirety. As a non-limiting example, the lipid particle can comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle. The nucleic acid in the nanoparticle can be the polynucleotides described herein and/or are known in the art.

In one embodiment, the LNP formulation can be formulated by the methods described in International Publication Nos. WO2011127255 or WO2008103276, the contents of each of which are herein incorporated by reference in their entirety. As a non-limiting example, modified RNA described herein can be encapsulated in LNP formulations as described in WO2011127255 and/or WO2008103276; the contents of each of which are herein incorporated by reference in their entirety.

In one embodiment, LNP formulations described herein can comprise a polycationic composition. As a non-limiting example, the polycationic composition can be selected from formula 1-60 of US Patent Publication No. US20050222064; the content of which is herein incorporated by reference in its entirety. In another embodiment, the LNP formulations comprising a polycationic composition can be used for the delivery of the modified RNA described herein in vivo and/or in vitro.

In one embodiment, the LNP formulations described herein can additionally comprise a permeability enhancer molecule. Non-limiting permeability enhancer molecules are described in US Patent Publication No. US20050222064; the content of which is herein incorporated by reference in its entirety.

In one embodiment, the polynucleotide pharmaceutical compositions can be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the Polynucleotides can be formulated in a lyophilized gel-phase liposomal composition as described in US Publication No. US2012060293, herein incorporated by reference in its entirety.

The nanoparticle formulations can comprise a phosphate conjugate. The phosphate conjugate can increase in vivo circulation times and/or increase the targeted delivery of the nanoparticle. Phosphate conjugates for use with the present disclosure can be made by the methods described in International Application No. WO2013033438 or US Patent Publication No. US20130196948, the contents of each of which are herein incorporated by reference in its entirety. As a non-limiting example, the phosphate conjugates can include a compound of any one of the formulas described in International Application No. WO2013033438, herein incorporated by reference in its entirety.

The nanoparticle formulation can comprise a polymer conjugate. The polymer conjugate can be a water soluble conjugate. The polymer conjugate can have a structure as described in U.S. Patent Application No. 20130059360, the contents of which are herein incorporated by reference in its entirety. In one aspect, polymer conjugates with the polynucleotides of the present disclosure can be made using the methods and/or segmented polymeric reagents described in U.S. Patent Application No. 20130072709, herein incorporated by reference in its entirety. In another aspect, the polymer conjugate can have pendant side groups comprising ring moieties such as, but not limited to, the polymer conjugates described in US Patent Publication No. US20130196948, the contents of which is herein incorporated by reference in its entirety.

The nanoparticle formulations can comprise a conjugate to enhance the delivery of nanoparticles of the present disclosure in a subject. Further, the conjugate can inhibit phagocytic clearance of the nanoparticles in a subject. In one aspect, the conjugate can be a "self" peptide designed from the human membrane protein CD47 (e.g., the "self" particles described by Rodriguez et al (Science 2013 339, 971-975), herein incorporated by reference in its entirety). As shown by Rodriguez et al. the self peptides delayed macrophage-mediated clearance of nanoparticles which enhanced delivery of the nanoparticles. In another aspect, the conjugate can be the membrane protein CD47 (e.g., see Rodriguez et al. Science 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In one embodiment, the Polynucleotides of the present disclosure are formulated in nanoparticles that comprise a conjugate to enhance the delivery of the nanoparticles of the present disclosure in a subject. The conjugate can be the CD47 membrane or the conjugate can be derived from the CD47 membrane protein, such as the "self" peptide described previously. In another aspect the nanoparticle can comprise PEG and a conjugate of CD47 or a derivative thereof. In yet another aspect, the nanoparticle can comprise both the "self" peptide described above and the membrane protein CD47.

In another aspect, a "self" peptide and/or CD47 protein can be conjugated to a virus-like particle or pseudovirion, as described herein for delivery of the Polynucleotides of the present disclosure.

In another embodiment, pharmaceutical compositions comprise the polynucleotides of the present disclosure and a conjugate that can have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in US Patent Publication No. US20130184443, the contents of which are herein incorporated by reference in its entirety.

The nanoparticle formulations can be a carbohydrate nanoparticle comprising a carbohydrate carrier and a polynucleotide. As a non-limiting example, the carbohydrate carrier can include, but is not limited to, an anhydride-modified phytoglycogen or glycogen-type material, phytoglycogen octenyl succinate, phytoglycogen beta-dextrin, anhydride-modified phytoglycogen beta-dextrin. (See, e.g., International Publication No. WO2012109121; the contents of which are herein incorporated by reference in its entirety).

Nanoparticle formulations of the present disclosure can be coated with a surfactant or polymer in order to improve the delivery of the particle. In one embodiment, the nanoparticle can be coated with a hydrophilic coating such as, but not limited to, PEG coatings and/or coatings that have a neutral surface charge. The hydrophilic coatings can help to deliver nanoparticles with larger payloads such as, but not limited to, Polynucleotides within the central nervous system. As a non-limiting example nanoparticles comprising a hydrophilic coating and methods of making such nanoparticles are described in US Patent Publication No. US20130183244, the contents of which are herein incorporated by reference in its entirety.

In one embodiment, the lipid nanoparticles of the present disclosure can be hydrophilic polymer particles. Non-limiting examples of hydrophilic polymer particles and methods of making hydrophilic polymer particles are described in US Patent Publication No. US20130210991, the contents of which are herein incorporated by reference in its entirety.

In another embodiment, the lipid nanoparticles of the present disclosure can be hydrophobic polymer particles.

Lipid nanoparticle formulations can be improved by replacing the cationic lipid with a biodegradable cationic lipid that is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and can be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it can be terminally located at the terminal end of the lipid chain. The internal ester linkage can replace any carbon in the lipid chain.

In one embodiment, the internal ester linkage can be located on either side of the saturated carbon.

Lipid nanoparticles can be engineered to alter the surface properties of particles so the lipid nanoparticles can penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm can be used for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles can be removed from the mucosal tissue within seconds or within a few hours. Large polymeric nanoparticles (200 nm-500 nm in diameter) that have been coated densely with a low molecular weight polyethylene glycol (PEG) diffused through mucus only 4 to 6-fold lower than the same particles diffusing in water (Lai et al. PNAS 2007 104(5):1482-487; Lai et al. Adv Drug Deliv Rev. 2009 61(2): 158-171; each of which is herein incorporated by reference in their entirety). The transport of nanoparticles can be determined using rates of permeation and/or fluorescent microscopy techniques including, but not limited to, fluorescence recovery after photobleaching (FRAP) and high resolution multiple particle tracking (MPT). As a non-limiting example, compositions that can penetrate a mucosal barrier can be made as described in U.S. Pat. No. 8,241,670 or International Patent Publication No. WO2013110028, the contents of each of which are herein incorporated by reference in its entirety.

The lipid nanoparticle engineered to penetrate mucus can comprise a polymeric material (i.e., a polymeric core) and/or a polymer-vitamin conjugate and/or a tri-block co-polymer. The polymeric material can include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates. The polymeric material can be biodegradable and/or biocompatible. Non-limiting examples of biocompatible polymers are described in International Patent Publication No. WO2013116804, the contents of which are herein incorporated by reference in its entirety. The polymeric material can additionally be irradiated. As a non-limiting example, the polymeric material can be gamma irradiated (See e.g., International App. No. WO201282165, herein incorporated by reference in its entirety). Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly (lactic acid-co-glycolic acid) (PLGA), poly(L-lactic acid-co-glycolic acid) (PLLGA), poly(D,L-lactide) (PDLA), poly (L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly (ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth) acrylate) (PMMA), poly(ethyl(meth)acrylate), poly(butyl (meth)acrylate), poly(isobutyl(meth)acrylate), poly(hexyl (meth)acrylate), poly(isodecyl(meth)acrylate), poly(lauryl (meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), PEG-PLGA-PEG and trimethylene carbonate, polyvinylpyrrolidone. The lipid nanoparticle can be coated or associated with a co-polymer such as, but not limited to, a block co-polymer (such as a branched polyether-polyamide block copolymer described in International Publication No. WO2013012476, herein incorporated by reference in its entirety), and (poly(ethylene glycol))-(poly(propylene oxide))-(poly(ethylene glycol)) triblock copolymer (see, e.g., US Publication 20120121718 and US Publication 20100003337 and U.S. Pat. No. 8,263, 665; each of which is herein incorporated by reference in their entirety). The co-polymer can be a polymer that is generally regarded as safe (GRAS) and the formation of the lipid nanoparticle can be in such a way that no new chemical entities are created. For example, the lipid nanoparticle can comprise poloxamers coating PLGA nanoparticles without forming new chemical entities that are still able to rapidly penetrate human mucus (Yang et al. Angew. Chem. Int. Ed. 2011 50:2597-2600; the contents of which are herein incorporated by reference in its entirety). A non-limiting scalable method to produce nanoparticles that can penetrate human mucus is described by Xu et al. (See, e.g., J Control Release 2013, 170(2):279-86; the contents of which are herein incorporated by reference in its entirety).

The vitamin of the polymer-vitamin conjugate can be vitamin E. The vitamin portion of the conjugate can be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus can include surface altering agents such as, but not limited to, polynucleotides, anionic proteins (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin 34 dornase alfa, neltenexine, erdosteine) and various DNases including rhDNase. The surface altering agent can be embedded or enmeshed in the particle's surface or disposed (e.g., by coating, adsorption, covalent linkage, or other process) on the surface of the lipid nanoparticle. (see e.g., US Publication 20100215580 and US Publication 20080166414 and US20130164343; the contents of each of which is herein incorporated by reference in their entirety).

In one embodiment, the mucus penetrating lipid nanoparticles can comprise at least one polynucleotide described herein. The polynucleotide can be encapsulated in the lipid nanoparticle and/or disposed on the surface of the particle. The polynucleotide can be covalently coupled to the lipid nanoparticle. Formulations of mucus penetrating lipid nanoparticles can comprise a plurality of nanoparticles. Further, the formulations can contain particles that can interact with the mucus and alter the structural and/or adhesive properties of the surrounding mucus to decrease mucoadhesion that can increase the delivery of the mucus penetrating lipid nanoparticles to the mucosal tissue.

In another embodiment, the mucus penetrating lipid nanoparticles can be a hypotonic formulation comprising a mucosal penetration enhancing coating. The formulation can be hypotonic for the epithelium to which it is being delivered. Non-limiting examples of hypotonic formulations can be found in International Patent Publication No. WO2013110028, the contents of which are herein incorporated by reference in its entirety.

In one embodiment, in order to enhance the delivery through the mucosal barrier the polynucleotide formulation can comprise or be a hypotonic solution. Hypotonic solutions were found to increase the rate at which mucoinert particles such as, but not limited to, mucus-penetrating particles, were able to reach the vaginal epithelial surface (see, e.g., Ensign et al. Biomaterials 2013 34(28):6922-9; the contents of which is herein incorporated by reference in its entirety).

In one embodiment, the polynucleotide is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In one embodiment such formulations can also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and DLin-MC3-DMA-based lipid nanoparticle formulations that have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012

820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the polynucleotide is formulated as a solid lipid nanoparticle. A solid lipid nanoparticle (SLN) can be spherical with an average diameter between 10 to 1000 nm. SLN possess a solid lipid core matrix that can solubilize lipophilic molecules and can be stabilized with surfactants and/or emulsifiers. In a further embodiment, the lipid nanoparticle can be a self-assembly lipid-polymer nanoparticle (see Zhang et al., ACS Nano, 2008, 2 (8), pp 1696-1702; the contents of which are herein incorporated by reference in its entirety). As a non-limiting example, the SLN can be the SLN described in International Patent Publication No. WO2013105101, the contents of which are herein incorporated by reference in its entirety. As another non-limiting example, the SLN can be made by the methods or processes described in International Patent Publication No. WO2013105101, the contents of which are herein incorporated by reference in its entirety.

Liposomes, lipoplexes, or lipid nanoparticles can be used to improve the efficacy of polynucleotides directed protein production as these formulations can be able to increase cell transfection by the polynucleotide; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles can also be used to increase the stability of the polynucleotide.

In one embodiment, the Polynucleotides of the present disclosure can be formulated for controlled release and/or targeted delivery. As used herein, "controlled release" refers to a pharmaceutical composition or compound release profile that conforms to a particular pattern of release to effect a therapeutic outcome. In one embodiment, the polynucleotides can be encapsulated into a delivery agent described herein and/or known in the art for controlled release and/or targeted delivery. As used herein, the term "encapsulate" means to enclose, surround or encase. As it relates to the formulation of the compounds of the disclosure, encapsulation can be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the disclosure can be enclosed, surrounded or encased within the delivery agent. "Partially encapsulation" means that less than 10, 10, 20, 30, 40 50 or less of the pharmaceutical composition or compound of the disclosure can be enclosed, surrounded or encased within the delivery agent. Advantageously, encapsulation can be determined by measuring the escape or the activity of the pharmaceutical composition or compound of the disclosure using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the disclosure are encapsulated in the delivery agent.

In one embodiment, the controlled release formulation can include, but is not limited to, tri-block co-polymers. As a non-limiting example, the formulation can include two different types of tri-block co-polymers (International Pub. No. WO2012131104 and WO2012131106; the contents of each of which is herein incorporated by reference in its entirety).

In another embodiment, the Polynucleotides can be encapsulated into a lipid nanoparticle or a rapidly eliminated lipid nanoparticle and the lipid nanoparticles or a rapidly eliminated lipid nanoparticle can then be encapsulated into a polymer, hydrogel and/or surgical sealant described herein and/or known in the art. As a non-limiting example, the polymer, hydrogel or surgical sealant can be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc. Deerfield, Ill.), PEG-based sealants, and COSEAL® (Baxter International, Inc. Deerfield, Ill.).

In another embodiment, the lipid nanoparticle can be encapsulated into any polymer known in the art that can form a gel when injected into a subject. As another non-limiting example, the lipid nanoparticle can be encapsulated into a polymer matrix that can be biodegradable.

In one embodiment, the polynucleotide formulation for controlled release and/or targeted delivery can also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In one embodiment, the polynucleotide controlled release and/or targeted delivery formulation can comprise at least one degradable polyester that can contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters can include a PEG conjugation to form a PEGylated polymer.

In one embodiment, the polynucleotide controlled release and/or targeted delivery formulation comprising at least one polynucleotide can comprise at least one PEG and/or PEG related polymer derivatives as described in U.S. Pat. No. 8,404,222, herein incorporated by reference in its entirety.

In another embodiment, the polynucleotide controlled release delivery formulation comprising at least one polynucleotide can be the controlled release polymer system described in US20130130348, herein incorporated by reference in its entirety.

In one embodiment, the Polynucleotides of the present disclosure can be encapsulated in a therapeutic nanoparticle, referred to herein as "therapeutic nanoparticle polynucleotides." Therapeutic nanoparticles can be formulated by methods described herein and known in the art such as, but not limited to, International Pub Nos. WO2010005740, WO2010030763, WO2010005721, WO2010005723, WO2012054923, US Pub. Nos. US20110262491, US20100104645, US20100087337, US20100068285, US20110274759, US20100068286, US20120288541, US20130123351 and US20130230567 and U.S. Pat. Nos. 8,206,747, 8,293,276, 8,318,208 and 8,318,211; the contents of each of which are herein incorporated by reference in their entirety. In another embodiment, therapeutic polymer nanoparticles can be identified by the methods described in US Pub No. US20120140790, the contents of which is herein incorporated by reference in its entirety.

In one embodiment, the therapeutic nanoparticle polynucleotide can be formulated for sustained release. As used herein, "sustained release" refers to a pharmaceutical composition or compound that conforms to a release rate over a specific period of time. The period of time can include, but is not limited to, hours, days, weeks, months and years. As a non-limiting example, the sustained release nanoparticle can comprise a polymer and a therapeutic agent such as, but not limited to, the polynucleotides of the present disclosure (see International Pub No. 2010075072 and US Pub No. US20100216804, US20110217377 and US20120201859, each of which is herein incorporated by reference in their entirety). In another non-limiting example, the sustained release formulation can comprise agents that permit persistent bioavailability such as, but not limited to, crystals, macromolecular gels and/or particulate suspensions (see US Patent Publication No US20130150295, the contents of which is herein incorporated by reference in its entirety).

In one embodiment, the therapeutic nanoparticle Polynucleotides can be formulated to be target specific. As a non-limiting example, the therapeutic nanoparticles can include a corticosteroid (see International Pub. No. WO2011084518; herein incorporated by reference in its entirety). As a non-limiting example, the therapeutic nanoparticles can be formulated in nanoparticles described in International Pub No. WO2008121949, WO2010005726, WO2010005725, WO2011084521 and US Pub No. US20100069426, US20120004293 and US20100104655, each of which is herein incorporated by reference in their entirety.

In one embodiment, the nanoparticles of the present disclosure can comprise a polymeric matrix. As a non-limiting example, the nanoparticle can comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer can include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester) or combinations thereof. In another embodiment, the diblock copolymer can comprise the diblock copolymers described in European Patent Publication No. the contents of which are herein incorporated by reference in its entirety. In yet another embodiment, the diblock copolymer can be a high-X diblock copolymer such as those described in International Patent Publication No. WO2013120052, the contents of which are herein incorporated by reference in its entirety.

As a non-limiting example the therapeutic nanoparticle comprises a PLGA-PEG block copolymer (see US Pub. No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012166923, the contents of each of which are herein incorporated by reference in its entirety). In yet another non-limiting example, the therapeutic nanoparticle is a stealth nanoparticle or a target-specific stealth nanoparticle as described in US Patent Publication No. US20130172406, the contents of which are herein incorporated by reference in its entirety.

In one embodiment, the therapeutic nanoparticle can comprise a multiblock copolymer (see, e.g., U.S. Pat. Nos. 8,263,665 and 8,287,910 and US Patent Pub. No. US20130195987; the contents of each of which are herein incorporated by reference in its entirety).

In yet another non-limiting example, the lipid nanoparticle comprises the block copolymer PEG-PLGA-PEG (see, e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety). The Polynucleotides of the present disclosure can be formulated in lipid nanoparticles comprising the PEG-PLGA-PEG block copolymer.

In one embodiment, the therapeutic nanoparticle can comprise a multiblock copolymer (see, e.g., U.S. Pat. Nos. 8,263,665 and 8,287,910 and US Patent Pub. No. US20130195987; the contents of each of which are herein incorporated by reference in its entirety).

In one embodiment, the block copolymers described herein can be included in a polyion complex comprising a non-polymeric micelle and the block copolymer (see, e.g., U.S. Pub. No. 20120076836; herein incorporated by reference in its entirety).

In one embodiment, the therapeutic nanoparticle can comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly (acrylic acid), poly(methacrylic acid), polycyanoacrylates and combinations thereof.

In one embodiment, the therapeutic nanoparticles can comprise at least one poly(vinyl ester) polymer. The poly (vinyl ester) polymer can be a copolymer such as a random copolymer. As a non-limiting example, the random copolymer can have a structure such as those described in International Application No. WO2013032829 or US Patent Publication No US20130121954, the contents of which are herein incorporated by reference in its entirety. In one aspect, the poly(vinyl ester) polymers can be conjugated to the polynucleotides described herein. In another aspect, the poly(vinyl ester) polymer that can be used in the present disclosure can be those described in, herein incorporated by reference in its entirety.

In one embodiment, the therapeutic nanoparticle can comprise at least one diblock copolymer. The diblock copolymer can be, but it not limited to, a poly(lactic) acid-poly(ethylene)glycol copolymer (see, e.g., International Patent Publication No. WO2013044219; herein incorporated by reference in its entirety).

In one embodiment, the therapeutic nanoparticles can comprise at least one cationic polymer described herein and/or known in the art.

In one embodiment, the therapeutic nanoparticles can comprise at least one amine-containing polymer such as, but not limited to polylysine, polyethylene imine, poly(amidoamine) dendrimers, poly(beta-amino esters) (see, e.g., U.S. Pat. No. 8,287,849; herein incorporated by reference in its entirety) and combinations thereof.

In another embodiment, the nanoparticles described herein can comprise an amine cationic lipid such as those described in International Patent Application No. WO2013059496, the contents of which are herein incorporated by reference in its entirety. In one aspect the cationic lipids can have an amino-amine or an amino-amide moiety.

In one embodiment, the therapeutic nanoparticles can comprise at least one degradable polyester that can contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters can include a PEG conjugation to form a PEGylated polymer.

In another embodiment, the therapeutic nanoparticle can include a conjugation of at least one targeting ligand. The targeting ligand can be any ligand known in the art such as, but not limited to, a monoclonal antibody. (Kirpotin et al, Cancer Res. 2006 66:6732-6740; herein incorporated by reference in its entirety).

In one embodiment, the therapeutic nanoparticle Polynucleotides, e.g., therapeutic nanoparticles comprising at least one polynucleotide can be formulated using the methods described by Podobinski et al in U.S. Pat. No. 8,404,799, the contents of which are herein incorporated by reference in its entirety.

In one embodiment, the Polynucleotides can be encapsulated in, linked to and/or associated with synthetic nanocarriers. Synthetic nanocarriers include, but are not limited to, those described in International Pub. Nos. WO2010005740, WO2010030763, WO201213501, WO2012149252, WO2012149255, WO2012149259, WO2012149265, WO2012149268, WO2012149282, WO2012149301, WO2012149393, WO2012149405, WO2012149411, WO2012149454 and WO2013019669, and US Pub. Nos. US20110262491, US20100104645, US20100087337 and US20120244222, each of which is herein incorporated by reference in their entirety. The synthetic nanocarriers can be formulated using methods known in the art and/or described herein. As a non-limiting example, the synthetic nanocarriers can be formulated by the methods described in International Pub Nos. WO2010005740, WO2010030763 and WO201213501 and US Pub. Nos. US20110262491, US20100104645, US20100087337 and US2012024422, each of which is herein incorporated by reference in their entirety. In another embodiment, the synthetic nanocarrier formulations can be lyophilized by methods described in International Pub. No. WO2011072218 and U.S. Pat. No. 8,211,473; the content of each of which is herein incorporated by reference in their entirety. In yet another embodiment, formulations of the present disclosure, including, but not limited to, synthetic nanocarriers, can be lyophilized or reconstituted by the methods described in US Patent Publication No. US20130230568, the contents of which are herein incorporated by reference in its entirety.

In one embodiment, the synthetic nanocarriers can contain reactive groups to release the polynucleotides described herein (see International Pub. No. WO20120952552 and US Pub No. US20120171229, each of which is herein incorporated by reference in their entirety).

In one embodiment, the synthetic nanocarriers can be formulated for targeted release. In one embodiment, the synthetic nanocarrier is formulated to release the polynucleotides at a specified pH and/or after a desired time interval. As a non-limiting example, the synthetic nanoparticle can be formulated to release the polynucleotides after 24 hours and/or at a pH of 4.5 (see International Pub. Nos. WO2010138193 and WO2010138194 and US Pub Nos. US20110020388 and US20110027217, each of which is herein incorporated by reference in their entireties).

In one embodiment, the synthetic nanocarriers can be formulated for controlled and/or sustained release of the polynucleotides described herein. As a non-limiting example, the synthetic nanocarriers for sustained release can be formulated by methods known in the art, described herein and/or as described in International Pub No. WO2010138192 and US Pub No. 20100303850, each of which is herein incorporated by reference in their entirety.

In one embodiment, the polynucleotide can be formulated for controlled and/or sustained release wherein the formulation comprises at least one polymer that is a crystalline side chain (CYSC) polymer. CYSC polymers are described in U.S. Pat. No. 8,399,007, herein incorporated by reference in its entirety.

In one embodiment, the synthetic nanocarrier can comprise at least one polynucleotide that encodes at least one adjuvant. As non-limiting example, the adjuvant can comprise dimethyldioctadecylammonium-bromide, dimethyldioctadecylammonium-chloride, dimethyldioctadecylammonium-phosphate or dimethyldioctadecylammonium-acetate (DDA) and an apolar fraction or part of said apolar fraction of a total lipid extract of a mycobacterium (See, e.g., U.S. Pat. No. 8,241,610; herein incorporated by reference in its entirety). In another embodiment, the synthetic nanocarrier can comprise at least one polynucleotide and an adjuvant. As a non-limiting example, the synthetic nanocarrier comprising and adjuvant can be formulated by the methods described in International Pub No. WO2011150240 and US Pub No. US20110293700, each of which is herein incorporated by reference in its entirety.

In one embodiment, the synthetic nanocarrier can encapsulate at least one polynucleotide that encodes a peptide, fragment or region from a virus. As a non-limiting example, the synthetic nanocarrier can include, but is not limited to, the nanocarriers described in International Pub No. WO2012024621, WO201202629, WO2012024632 and US Pub No. US20120064110, US20120058153 and US20120058154, each of which is herein incorporated by reference in their entirety.

In one embodiment, the synthetic nanocarrier can be coupled to a polynucleotide that can be able to trigger a humoral and/or cytotoxic T lymphocyte (CTL) response (see, e.g., International Publication No. WO2013019669, herein incorporated by reference in its entirety).

In one embodiment, the polynucleotide can be encapsulated in, linked to and/or associated with zwitterionic lipids. Non-limiting examples of zwitterionic lipids and methods of using zwitterionic lipids are described in US Patent Publication No. US20130216607, the contents of which are herein incorporated by reference in its entirety. In one aspect, the zwitterionic lipids can be used in the liposomes and lipid nanoparticles described herein.

In one embodiment, the polynucleotide can be formulated in colloid nanocarriers as described in US Patent Publication No. US20130197100, the contents of which are herein incorporated by reference in its entirety.

In one embodiment, the nanoparticle can be optimized for oral administration. The nanoparticle can comprise at least one cationic biopolymer such as, but not limited to, chitosan or a derivative thereof. As a non-limiting example, the nanoparticle can be formulated by the methods described in U.S. Pub. No. 20120282343; herein incorporated by reference in its entirety.

In some embodiments, LNPs comprise the lipid KL52 (an amino-lipid disclosed in U.S. Application Publication No. 2012/0295832 expressly incorporated herein by reference in its entirety). Activity and/or safety (as measured by examining one or more of ALT/AST, white blood cell count and cytokine induction) of LNP administration can be improved by incorporation of such lipids. LNPs comprising KL52 can be administered intravenously and/or in one or more doses. In some embodiments, administration of LNPs comprising KL52 results in equal or improved mRNA and/or protein expression as compared to LNPs comprising MC3.

In some embodiments, polynucleotide can be delivered using smaller LNPs. Such particles can comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, or less than 975 um.

In another embodiment, polynucleotides can be delivered using smaller LNPs that can comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Exemplary microfluidic mixers can include, but are not limited to a slit interdigitial micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51; each of which is herein incorporated by reference in its entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method can also comprise a surface for fluid mixing wherein the surface changes orientations during fluid cycling. Methods of generating LNPs using SHM include those disclosed in U.S. Application Publication Nos. 2004/0262223 and 2012/0276209, each of which is expressly incorporated herein by reference in their entirety.

In one embodiment, the polynucleotide of the present disclosure can be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany).

In one embodiment, the polynucleotides of the present disclosure can be formulated in lipid nanoparticles created using microfluidic technology (see Whitesides, George M. The Origins and the Future of Microfluidics. Nature, 2006 442: 368-373; and Abraham et al. Chaotic Mixer for Microchannels. Science, 2002 295: 647-651; each of which is herein incorporated by reference in its entirety). As a non-limiting example, controlled microfluidic formulation includes a passive method for mixing streams of steady pressure-driven flows in micro channels at a low Reynolds number (see, e.g., Abraham et al. Chaotic Mixer for Microchannels. Science, 2002 295: 647-651; which is herein incorporated by reference in its entirety).

In one embodiment, the polynucleotides of the present disclosure can be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In one embodiment, the polynucleotides of the disclosure can be formulated for delivery using the drug encapsulating microspheres described in International Patent Publication No. WO2013063468 or U.S. Pat. No. 8,440,614, each of which is herein incorporated by reference in its entirety. The microspheres can comprise a compound of the formula (I), (II), (III), (IV), (V) or (VI) as described in International Patent Publication No. WO2013063468, the contents of which are herein incorporated by reference in its entirety. In another aspect, the amino acid, peptide, polypeptide, lipids (APPL) are useful in delivering the polynucleotides of the disclosure to cells (see International Patent Publication No. WO2013063468, the contents of which is herein incorporated by reference in its entirety).

In one embodiment, the polynucleotides of the disclosure can be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm, about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the lipid nanoparticles can have a diameter from about 10 to 500 nm.

In one embodiment, the lipid nanoparticle can have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In one aspect, the lipid nanoparticle can be a limit size lipid nanoparticle described in International Patent Publication No. WO2013059922, the contents of which are herein incorporated by reference in its entirety. The limit size lipid nanoparticle can comprise a lipid bilayer surrounding an aqueous core or a hydrophobic core; where the lipid bilayer can comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In another aspect the limit size lipid nanoparticle can comprise a polyethylene glycol-lipid such as, but not limited to, DLPE-PEG, DMPE-PEG, DPPC-PEG and DSPE-PEG.

In one embodiment, the polynucleotides can be delivered, localized and/or concentrated in a specific location using the delivery methods described in International Patent Publication No. WO2013063530, the contents of which are herein incorporated by reference in its entirety. As a non-limiting example, a subject can be administered an empty polymeric particle prior to, simultaneously with or after delivering the polynucleotides to the subject. The empty polymeric particle undergoes a change in volume once in contact with the subject and becomes lodged, embedded, immobilized or entrapped at a specific location in the subject.

In one embodiment, the polynucleotides can be formulated in an active substance release system (see, e.g., US Patent Publication No. US20130102545, the contents of which is herein incorporated by reference in its entirety). The active substance release system can comprise 1) at least one nanoparticle bonded to an oligonucleotide inhibitor strand that is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In one embodiment, the polynucleotides can be formulated in a nanoparticle comprising an inner core comprising a non-cellular material and an outer surface comprising a cellular membrane. The cellular membrane can be derived from a cell or a membrane derived from a virus. As a non-limiting example, the nanoparticle can be made by the methods described in International Patent Publication No. WO2013052167, herein incorporated by reference in its entirety. As another non-limiting example, the nanoparticle described in International Patent Publication No. WO2013052167, herein incorporated by reference in its entirety, can be used to deliver the polynucleotides described herein.

In one embodiment, the polynucleotides can be formulated in porous nanoparticle-supported lipid bilayers (protocells). Protocells are described in International Patent Publication No. WO2013056132, the contents of which are herein incorporated by reference in its entirety.

In one embodiment, the polynucleotides described herein can be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle can have a high glass transition temperature such as the nanoparticles described in or nanoparticles made by the methods described in U.S. Pat. No. 8,518,963, the contents of which are herein incorporated by reference in its entirety. As another non-limiting example, the polymer nanoparticle for oral and parenteral formulations can be made by the methods described in European Patent No. EP2073848B1, the contents of which are herein incorporated by reference in its entirety.

In another embodiment, the polynucleotides described herein can be formulated in nanoparticles used in imaging. The nanoparticles can be liposome nanoparticles such as those described in US Patent Publication No US20130129636, herein incorporated by reference in its entirety. As a non-limiting example, the liposome can comprise gadolinium(III)2-{4,7-bis-carboxymethyl-10-[(N,N-distearylamidomethyl-N'-amido-methyl]-1,4,7,10-tetra-aza-cyclododec-1-yl}-acetic acid and a neutral, fully saturated phospholipid component (see, e.g., US Patent Publication No US20130129636, the contents of which is herein incorporated by reference in its entirety).

In one embodiment, the nanoparticles that can be used in the present disclosure are formed by the methods described in U.S. Patent Application No. US20130130348, the contents of which is herein incorporated by reference in its entirety.

The nanoparticles of the present disclosure can further include nutrients such as, but not limited to, those which deficiencies can lead to health hazards from anemia to neural tube defects (see e.g., the nanoparticles described in International Patent Publication No WO2013072929, the contents of which is herein incorporated by reference in its entirety). As a non-limiting example, the nutrient can be iron in the form of ferrous, ferric salts or elemental iron, iodine, folic acid, vitamins or micronutrients.

In one embodiment, the polynucleotides of the present disclosure can be formulated in a swellable nanoparticle. The swellable nanoparticle can be, but is not limited to, those described in U.S. Pat. No. 8,440,231, the contents of which is herein incorporated by reference in its entirety. As a non-limiting embodiment, the swellable nanoparticle can be used for delivery of the polynucleotides of the present disclosure to the pulmonary system (see, e.g., U.S. Pat. No. 8,440,231, the contents of which is herein incorporated by reference in its entirety).

The polynucleotides of the present disclosure can be formulated in polyanhydride nanoparticles such as, but not limited to, those described in U.S. Pat. No. 8,449,916, the contents of which is herein incorporated by reference in its entirety.

The nanoparticles and microparticles of the present disclosure can be geometrically engineered to modulate macrophage and/or the immune response. In one aspect, the geometrically engineered particles can have varied shapes, sizes and/or surface charges in order to incorporated the polynucleotides of the present disclosure for targeted delivery such as, but not limited to, pulmonary delivery (see, e.g., International Publication No WO2013082111, the contents of which is herein incorporated by reference in its entirety). Other physical features the geometrically engineering particles can have include, but are not limited to, fenestrations, angled arms, asymmetry and surface roughness, charge that can alter the interactions with cells and tissues. As a non-limiting example, nanoparticles of the present disclosure can be made by the methods described in International Publication No WO2013082111, the contents of which is herein incorporated by reference in its entirety.

In one embodiment, the nanoparticles of the present disclosure can be water soluble nanoparticles such as, but not limited to, those described in International Publication No. WO2013090601, the contents of which is herein incorporated by reference in its entirety. The nanoparticles can be inorganic nanoparticles that have a compact and zwitterionic ligand in order to exhibit good water solubility. The nanoparticles can also have small hydrodynamic diameters (HD), stability with respect to time, pH, and salinity and a low level of non-specific protein binding.

In one embodiment the nanoparticles of the present disclosure can be developed by the methods described in US Patent Publication No. US20130172406, the contents of which are herein incorporated by reference in its entirety.

In one embodiment, the nanoparticles of the present disclosure are stealth nanoparticles or target-specific stealth nanoparticles such as, but not limited to, those described in US Patent Publication No. US20130172406; the contents of which is herein incorporated by reference in its entirety. The nanoparticles of the present disclosure can be made by the methods described in US Patent Publication No. US20130172406, the contents of which is herein incorporated by reference in its entirety.

In another embodiment, the stealth or target-specific stealth nanoparticles can comprise a polymeric matrix. The polymeric matrix can comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In one embodiment, the nanoparticle can be a nanoparticle-nucleic acid hybrid structure having a high density nucleic acid layer. As a non-limiting example, the nanoparticle-nucleic acid hybrid structure can made by the methods described in US Patent Publication No. US20130171646, the contents of which are herein incorporated by reference in its entirety. The nanoparticle can comprise a nucleic acid such as, but not limited to, polynucleotides described herein and/or known in the art.

At least one of the nanoparticles of the present disclosure can be embedded in in the core a nanostructure or coated with a low density porous 3-D structure or coating that is capable of carrying or associating with at least one payload within or on the surface of the nanostructure. Non-limiting examples of the nanostructures comprising at least one nanoparticle are described in International Patent Publication No. WO2013123523, the contents of which are herein incorporated by reference in its entirety.

Amino Acid Lipids

The disclosure also includes pharmaceutical compositions that comprise a formulation of the polynucleotide described herein, i.e., a polynucleotide comprising an ORF encoding an MCM polypeptide, with amino acid lipids. Amino acid lipids are lipophilic compounds comprising an amino acid residue and one or more lipophilic tails. Non-limiting examples of amino acid lipids and methods of making amino acid lipids are described in U.S. Pat. No. 8,501,824, the contents of which are herein incorporated by reference in its entirety.

In some embodiments, the amino acid lipids have a hydrophilic portion and a lipophilic portion. The hydrophilic portion can be an amino acid residue and a lipophilic portion can comprise at least one lipophilic tail.

In some embodiments, the amino acid lipid formulations can be used to deliver the polynucleotides to a subject.

In another embodiment, the amino acid lipid formulations can deliver a polynucleotide in releasable form that comprises an amino acid lipid that binds and releases the polynucleotides. As a non-limiting example, the release of the polynucleotides can be provided by an acid-labile linker such as, but not limited to, those described in U.S. Pat. Nos. 7,098,032, 6,897,196, 6,426,086, 7,138,382, 5,563,250, and 5,505,931, the contents of each of which are herein incorporated by reference in its entirety.

Polymers, Biodegradable Nanoparticles, and Core-Shell Nanoparticles

The disclosure also includes pharmaceutical compositions that comprise a formulation of the polynucleotide described herein, i.e., a polynucleotide comprising an ORF encoding an MCM polypeptide, using natural and/or synthetic polymers. Non-limiting examples of polymers that can be used for delivery include, but are not limited to, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (PHASERX®, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX® (Seattle, Wash.).

A non-limiting example of chitosan formulation includes a core of positively charged chitosan and an outer portion of negatively charged substrate (U.S. Pub. No. 20120258176; herein incorporated by reference in its entirety). Chitosan includes, but is not limited to N-trimethyl chitosan, mono-N-carboxymethyl chitosan (MCC), N-palmitoyl chitosan (NPCS), EDTA-chitosan, low molecular weight chitosan, chitosan derivatives, or combinations thereof.

In some embodiments, the polymers used in the present disclosure have undergone processing to reduce and/or inhibit the attachment of unwanted substances such as, but not limited to, bacteria, to the surface of the polymer. The polymer can be processed by methods known and/or described in the art and/or described in International Pub. No. WO2012150467, herein incorporated by reference in its entirety.

A non-limiting example of PLGA formulations include, but are not limited to, PLGA injectable depots (e.g., ELIGARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles *Hum Gene Ther.* 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles (see, e.g., US Patent Publication No. US20130156721, herein incorporated by reference in its entirety). The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887; herein incorporated by reference in its entirety). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887; herein incorporated by reference in its entirety). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI1 gene product in transferrin receptor-expressing Ewing's sarcoma tumor cells (Hu-Lieskovan et al., Cancer Res.2005 65: 8984-8982; herein incorporated by reference in its entirety) and siRNA formulated in these nanoparticles was well tolerated in non-human primates (Heidel et al., Proc Natl Acad Sci USA 2007 104:5715-21; herein incorporated by reference in its entirety). Both of these delivery strategies incorporate rational approaches using both targeted delivery and endosomal escape mechanisms.

The polymer formulation can permit the sustained or delayed release of polynucleotides (e.g., following intramuscular or subcutaneous injection). The altered release profile for the polynucleotide can result in, for example, translation of an encoded protein over an extended period of time. The polymer formulation can also be used to increase the stability of the polynucleotide. Biodegradable polymers have been previously used to protect nucleic acids other than polynucleotide from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132; Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; each of which is herein incorporated by reference in its entirety).

In some embodiments, the pharmaceutical compositions can be sustained release formulations. In a further embodiment, the sustained release formulations can be for subcutaneous delivery. Sustained release formulations can include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc. Deerfield, Ill.), PEG-based sealants, and COSEAL® (Baxter International, Inc. Deerfield, Ill.).

As a non-limiting example modified mRNA can be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradable, biocompatible polymers that are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device that can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic interaction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-

668; Davis, Nature 2010 464:1067-1070; each of which is herein incorporated by reference in its entirety).

The polynucleotides of the disclosure can be formulated with or in a polymeric compound. The polymer can include at least one polymer such as, but not limited to, polyethenes, polyethylene glycol (PEG), poly(1-lysine)(PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, elastic biodegradable polymer, biodegradable block copolymer, biodegradable random copolymer, biodegradable polyester copolymer, biodegradable polyester block copolymer, biodegradable polyester block random copolymer, multiblock copolymers, linear biodegradable copolymer, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester), acrylic polymers, amine-containing polymers, dextran polymers, dextran polymer derivatives or combinations thereof.

As a non-limiting example, the polynucleotides of the disclosure can be formulated with the polymeric compound of PEG grafted with PLL as described in U.S. Pat. No. 6,177,274; herein incorporated by reference in its entirety. The formulation can be used for transfecting cells in vitro or for in vivo delivery of polynucleotide. In another example, the polynucleotide can be suspended in a solution or medium with a cationic polymer, in a dry pharmaceutical composition or in a solution that is capable of being dried as described in U.S. Pub. Nos. 20090042829 and 20090042825; each of which are herein incorporated by reference in their entireties.

As another non-limiting example the polynucleotides of the disclosure can be formulated with a PLGA-PEG block copolymer (see US Pub. No. US20120004293 and U.S. Pat. No. 8,236,330, herein incorporated by reference in their entireties) or PLGA-PEG-PLGA block copolymers (See U.S. Pat. No. 6,004,573, herein incorporated by reference in its entirety). As a non-limiting example, the polynucleotides of the disclosure can be formulated with a diblock copolymer of PEG and PLA or PEG and PLGA (see U.S. Pat. No. 8,246,968, herein incorporated by reference in its entirety).

A polyamine derivative can be used to deliver nucleic acids or to treat and/or prevent a disease or to be included in an implantable or injectable device (U.S. Pub. No. 20100260817 (now U.S. Pat. No. 8,460,696) the contents of each of which is herein incorporated by reference in its entirety). As a non-limiting example, a pharmaceutical composition can include the polynucleotide and the polyamine derivative described in U.S. Pub. No. 20100260817 (now U.S. Pat. No. 8,460,696; the contents of which are incorporated herein by reference in its entirety. As a non-limiting example the polynucleotides of the present disclosure can be delivered using a polyamine polymer such as, but not limited to, a polymer comprising a 1,3-dipolar addition polymer prepared by combining a carbohydrate diazide monomer with a dialkyne unite comprising oligoamines (U.S. Pat. No. 8,236,280; herein incorporated by reference in its entirety).

The polynucleotides of the disclosure can be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In some embodiments, the polynucleotides of the present disclosure can be formulated with at least one polymer and/or derivatives thereof described in International Publication Nos. WO2011115862, WO2012082574 and WO2012068187 and U.S. Pub. No. 20120283427, each of which are herein incorporated by reference in their entireties. In another embodiment, the polynucleotides of the present disclosure can be formulated with a polymer of formula Z as described in WO2011115862, herein incorporated by reference in its entirety. In yet another embodiment, the polynucleotides can be formulated with a polymer of formula Z, Z' or Z" as described in International Pub. Nos. WO2012082574 or WO2012068187 and U.S. Pub. No. 2012028342, each of which are herein incorporated by reference in their entireties. The polymers formulated with the modified RNA of the present disclosure can be synthesized by the methods described in International Pub. Nos. WO2012082574 or WO2012068187, each of which are herein incorporated by reference in their entireties.

The polynucleotides of the disclosure can be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

Formulations of polynucleotides of the disclosure can include at least one amine-containing polymer such as, but not limited to polylysine, polyethylene imine, poly(amidoamine) dendrimers, poly(amine-co-esters) or combinations thereof. As a non-limiting example, the poly(amine-co-esters) can be the polymers described in and/or made by the methods described in International Publication No WO2013082529, the contents of which are herein incorporated by reference in its entirety.

For example, the polynucleotides of the disclosure can be formulated in a pharmaceutical compound including a poly (alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer can be made by methods known in the art and/or described in U.S. Pat. No. 6,696,038, U.S. App. Nos. 20030073619 and 20040142474 each of which is herein incorporated by reference in their entireties. The poly(alkylene imine) can be made using methods known in the art and/or as described in U.S. Pub. No. 20100004315, herein incorporated by reference in its entirety. The biodegradable polymer, biodegradable block copolymer, the biodegradable random copolymer, biodegradable polyester block copolymer, biodegradable polyester polymer, or biodegradable polyester random copolymer can be made using methods known in the art and/or as described in U.S. Pat. Nos. 6,517,869 and 6,267,987, the contents of which are each incorporated herein by reference in their entirety. The linear biodegradable copolymer can be made using methods known in the art and/or as described in U.S. Pat. No. 6,652,886. The PAGA polymer can be made using methods known in the art and/or as described in U.S. Pat. No. 6,217,912 herein incorporated by reference in its entirety. The PAGA polymer can be copolymerized to form a copolymer or block copolymer with polymers such as but not limited to, poly-L-lysine, polyarginine, polyornithine, histones, avidin, protamines, polylactides and poly(lactide-co-glycolides). The biodegradable cross-linked cationic multi-block copolymers can be made my methods known in the art and/or as described in U.S. Pat. Nos. 8,057,821, 8,444,992 or U.S. Pub. No. 2012009145 each of which are herein incorporated by reference in their entireties. For example, the multi-block copolymers can be synthesized using linear polyethyleneimine (LPEI) blocks that have distinct patterns as compared to branched polyethyl-eneimines. Further, the composition or pharmaceutical composition can be made by the methods known in the art, described herein, or as described in U.S. Pub. No. 20100004315 or U.S. Pat. Nos. 6,267,987 and 6,217,912 each of which are herein incorporated by reference in their entireties.

The polynucleotides of the disclosure can be formulated with at least one degradable polyester that can contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters can include a PEG conjugation to form a PEGylated polymer.

The polynucleotides of the disclosure can be formulated with at least one crosslinkable polyester. Crosslinkable polyesters include those known in the art and described in US Pub. No. 20120269761, the contents of which is herein incorporated by reference in its entirety.

The polynucleotides of the disclosure can be formulated in or with at least one cyclodextrin polymer. Cyclodextrin polymers and methods of making cyclodextrin polymers include those known in the art and described in US Pub. No. 20130184453, the contents of which are herein incorporated by reference in its entirety.

In some embodiments, the polynucleotides of the disclosure can be formulated in or with at least one crosslinked cation-binding polymers. Crosslinked cation-binding polymers and methods of making crosslinked cation-binding polymers include those known in the art and described in International Patent Publication No. WO2013106072, WO2013106073 and WO2013106086, the contents of each of which are herein incorporated by reference in its entirety.

In some embodiments, the polynucleotides of the disclosure can be formulated in or with at least one branched polymer. Branched polymers and methods of making branched polymers include those known in the art and described in International Patent Publication No. WO2013113071, the contents of each of which are herein incorporated by reference in its entirety.

In some embodiments, the polynucleotides of the disclosure can be formulated in or with at least PEGylated albumin polymer. PEGylated albumin polymer and methods of making PEGylated albumin polymer include those known in the art and described in US Patent Publication No. US20130231287, the contents of each of which are herein incorporated by reference in its entirety.

In some embodiments, the polymers described herein can be conjugated to a lipid-terminating PEG. As a non-limiting example, PLGA can be conjugated to a lipid-terminating PEG forming PLGA-DSPE-PEG. As another non-limiting example, PEG conjugates for use with the present disclosure are described in International Publication No. WO2008103276, herein incorporated by reference in its entirety. The polymers can be conjugated using a ligand conjugate such as, but not limited to, the conjugates described in U.S. Pat. No. 8,273,363, herein incorporated by reference in its entirety.

In some embodiments, the polynucleotides disclosed herein can be mixed with the PEGs or the sodium phosphate/sodium carbonate solution prior to administration. In another embodiment, a polynucleotides encoding a protein of interest can be mixed with the PEGs and also mixed with the sodium phosphate/sodium carbonate solution. In yet another embodiment, polynucleotides encoding a protein of interest can be mixed with the PEGs and a polynucleotides encoding a second protein of interest can be mixed with the sodium phosphate/sodium carbonate solution.

In some embodiments, the polynucleotides described herein can be conjugated with another compound. Non-limiting examples of conjugates are described in U.S. Pat. Nos. 7,964,578 and 7,833,992, each of which are herein incorporated by reference in their entireties. In another embodiment, modified RNA of the present disclosure can be conjugated with conjugates of formula 1-122 as described in U.S. Pat. Nos. 7,964,578 and 7,833,992, each of which are herein incorporated by reference in their entireties. The polynucleotides described herein can be conjugated with a metal such as, but not limited to, gold. (See, e.g., Giljohann et al. Journ. Amer. Chem. Soc. 2009 131(6): 2072-2073; herein incorporated by reference in its entirety). In another embodiment, the polynucleotides described herein can be conjugated and/or encapsulated in gold-nanoparticles. (International Pub. No. WO201216269 and U.S. Pub. No. 20120302940 and US20130177523; the contents of each of which is herein incorporated by reference in its entirety).

As described in U.S. Pub. No. 20100004313, herein incorporated by reference in its entirety, a gene delivery composition can include a nucleotide sequence and a poloxamer. For example, the polynucleotides of the present disclosure can be used in a gene delivery composition with the poloxamer described in U.S. Pub. No. 20100004313.

In some embodiments, the polymer formulation of the present disclosure can be stabilized by contacting the polymer formulation, which can include a cationic carrier, with a cationic lipopolymer that can be covalently linked to cholesterol and polyethylene glycol groups. The polymer formulation can be contacted with a cationic lipopolymer using the methods described in U.S. Pub. No. 20090042829 herein incorporated by reference in its entirety. The cationic carrier can include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane(DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B-[N—(N',N'-Dimethylaminoethane)-carbamoyl]Cholesterol Hydrochloride (DC-Cholesterol HCl) diheptadecylamidoglycyl spermidine (DOGS), N,N-di stearyl-N,N-dimethylammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof. As a non-limiting example, the polynucleotides can be formulated with a cationic lipopolymer such as those described in U.S. Patent Application No. 20130065942, herein incorporated by reference in its entirety.

The polynucleotides of the disclosure can be formulated in a polyplex of one or more polymers (See, e.g., U.S. Pat. No. 8,501,478, U.S. Pub. No. 20120237565 and 20120270927 and 20130149783 and International Patent Pub. No. WO2013090861; the contents of each of which is herein incorporated by reference in its entirety). As a non-limiting example, the polyplex can be formed using the novel alpha-aminoamidine polymers described in International Publication No. WO2013090861, the contents of which are herein incorporated by reference in its entirety. As another non-limiting example, the polyplex can be formed using the click polymers described in U.S. Pat. No. 8,501,478, the contents of which is herein incorporated by reference in its entirety.

In some embodiments, the polyplex comprises two or more cationic polymers. The cationic polymer can comprise a poly(ethylene imine) (PEI) such as linear PEI. In another embodiment, the polyplex comprises p(TETA/CBA) its PEGylated analog p(TETA/CBA)-g-PEG2k and mixtures thereof (see, e.g., US Patent Publication No. US20130149783, the contents of which are herein incorporated by reference in its entirety.

The polynucleotides of the disclosure can also be formulated as a nanoparticle using a combination of polymers, lipids, and/or other biodegradable agents, such as, but not limited to, calcium phosphate. Components can be combined in a core-shell, hybrid, and/or layer-by-layer architecture, to allow for fine-tuning of the nanoparticle so to delivery of the polynucleotide, polynucleotides can be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety). As a non-limiting example, the nanoparticle can comprise a plurality of polymers such as, but not limited to hydrophilic-hydrophobic polymers (e.g., PEG-PLGA), hydrophobic polymers (e.g., PEG) and/or hydrophilic polymers (International Pub. No. WO20120225129; the contents of which is herein incorporated by reference in its entirety).

As another non-limiting example the nanoparticle comprising hydrophilic polymers for the polynucleotides can be those described in or made by the methods described in International Patent Publication No. WO2013119936, the contents of which are herein incorporated by reference in its entirety.

In some embodiments, the biodegradable polymers that can be used in the present disclosure are poly(ether-anhydride) block copolymers. As a non-limiting example, the biodegradable polymers used herein can be a block copolymer as described in International Patent Publication No WO2006063249, herein incorporated by reference in its entirety, or made by the methods described in International Patent Publication No WO2006063249, herein incorporated by reference in its entirety.

In another embodiment, the biodegradable polymers that can be used in the present disclosure are alkyl and cycloalkyl terminated biodegradable lipids. As a non-limiting example, the alkyl and cycloalkyl terminated biodegradable lipids can be those described in International Publication No. WO2013086322 and/or made by the methods described in International Publication No. WO2013086322; the contents of which are herein incorporated by reference in its entirety.

In yet another embodiment, the biodegradable polymers that can be used in the present disclosure are cationic lipids having one or more biodegradable group located in a lipid moiety. As a non-limiting example, the biodegradable lipids can be those described in US Patent Publication No. US20130195920, the contents of which are herein incorporated by reference in its entirety.

Biodegradable calcium phosphate nanoparticles in combination with lipids and/or polymers have been shown to deliver polynucleotides in vivo. In some embodiments, a lipid coated calcium phosphate nanoparticle, which can also contain a targeting ligand such as anisamide, can be used to deliver the polynucleotide, polynucleotides of the present disclosure. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol Ther. 2012 20:609-615; herein incorporated by reference in its entirety). This delivery system combines both a targeted nanoparticle and a component to enhance the endosomal escape, calcium phosphate, in order to improve delivery of the siRNA.

In some embodiments, calcium phosphate with a PEG-polyanion block copolymer can be used to delivery polynucleotides (Kazikawa et al., J Contr Rel. 2004 97:345-356; Kazikawa et al., J Contr Rel. 2006 111:368-370; the contents of each of which are herein incorporated by reference in its entirety).

In some embodiments, a PEG-charge-conversional polymer (Pitella et al., Biomaterials. 2011 32:3106-3114; the contents of which are herein incorporated by reference in its entirety) can be used to form a nanoparticle to deliver the polynucleotides of the present disclosure. The PEG-charge-conversional polymer can improve upon the PEG-polyanion block copolymers by being cleaved into a polycation at acidic pH, thus enhancing endosomal escape.

In some embodiments, a polymer used in the present disclosure can be a pentablock polymer such as, but not limited to, the pentablock polymers described in International Patent Publication No. WO2013055331, herein incorporated by reference in its entirety. As a non-limiting example, the pentablock polymer comprises PGA-PCL-PEG-PCL-PGA, wherein PEG is polyethylene glycol, PCL is poly(E-caprolactone), PGA is poly(glycolic acid), and PLA is poly(lactic acid). As another non-limiting example, the pentablock polymer comprises PEG-PCL-PLA-PCL-PEG, wherein PEG is polyethylene glycol, PCL is poly(E-caprolactone), PGA is poly(glycolic acid), and PLA is poly(lactic acid).

In some embodiments, a polymer that can be used in the present disclosure comprises at least one diepoxide and at least one aminoglycoside (See, e.g., International Patent Publication No. WO2013055971, the contents of which are herein incorporated by reference in its entirety). The diepoxide can be selected from, but is not limited to, 1,4 butanediol diglycidyl ether (1,4B), 1,4-cyclohexanedimethanol diglycidyl ether (1,4C), 4-vinylcyclohexene diepoxide (4VCD), ethyleneglycol diglycidyl ether (EDGE), glycerol diglycidyl ether (GDE), neopentylglycol diglycidyl ether (NPDGE), poly(ethyleneglycol) diglycidyl ether (PEGDE), poly(propyleneglycol) diglycidyl ether (PPGDE) and resorcinol diglycidyl ether (RDE). The aminoglycoside can be selected from, but is not limited to, streptomycin, neomycin, framycetin, paromomycin, ribostamycin, kanamycin, amikacin, arbekacin, bekanamycin, dibekacin, tobramycin, spectinomycin, hygromycin, gentamicin, netilmicin, sisomicin, isepamicin, verdamicin, astromicin, and apramycin. As a non-limiting example, the polymers can be made by the methods described in International Patent Publication No. WO2013055971, the contents of which are herein incorporated by reference in its entirety. As another non-limiting example, compositions comprising any of the polymers comprising at least one least one diepoxide and at least one aminoglycoside can be made by the methods described in International Patent Publication No. WO2013055971, the contents of which are herein incorporated by reference in its entirety.

In some embodiments, a polymer that can be used in the present disclosure can be a cross-linked polymer. As a non-limiting example, the cross-linked polymers can be used to form a particle as described in U.S. Pat. No. 8,414,927, the contents of which are herein incorporated by reference in its entirety. As another non-limiting example, the cross-linked polymer can be obtained by the methods described in US Patent Publication No. US20130172600, the contents of which are herein incorporated by reference in its entirety.

In another embodiment, a polymer that can be used in the present disclosure can be a cross-linked polymer such as those described in U.S. Pat. No. 8,461,132, the contents of which are herein incorporated by reference in its entirety. As a non-limiting example, the cross-linked polymer can be used in a therapeutic composition for the treatment of a body tissue. The therapeutic composition can be administered to damaged tissue using various methods known in the art and/or described herein such as injection or catheterization.

In some embodiments, a polymer that can be used in the present disclosure can be a di-alphatic substituted pegylated lipid such as, but not limited to, those described in International Patent Publication No. WO2013049328, the contents of which are herein incorporated by reference in its entirety.

In some embodiments, a block copolymer is PEG-PLGA-PEG (see, e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety) can be used in the present disclosure. The present disclosure can be formulated with PEG-PLGA-PEG for administration such as, but not limited to, intramuscular and subcutaneous administration.

In another embodiment, the PEG-PLGA-PEG block copolymer is used in the present disclosure to develop a biodegradable sustained release system. In one aspect, the polynucleotides of the present disclosure are mixed with the block copolymer prior to administration. In another aspect, the polynucleotides acids of the present disclosure are co-administered with the block copolymer.

In some embodiments, the polymer used in the present disclosure can be a multi-functional polymer derivative such as, but not limited to, a multi-functional N-maleimidyl polymer derivatives as described in U.S. Pat. No. 8,454,946, the contents of which are herein incorporated by reference in its entirety.

The use of core-shell nanoparticles has additionally focused on a high-throughput approach to synthesize cationic cross-linked nanogel cores and various shells (Siegwart et al., Proc Natl Acad Sci USA. 2011 108:12996-13001; the contents of which are herein incorporated by reference in its entirety). The complexation, delivery, and internalization of the polymeric nanoparticles can be precisely controlled by altering the chemical composition in both the core and shell components of the nanoparticle. For example, the core-shell nanoparticles can efficiently deliver siRNA to mouse hepatocytes after they covalently attach cholesterol to the nanoparticle.

In some embodiments, a hollow lipid core comprising a middle PLGA layer and an outer neutral lipid layer containing PEG can be used to delivery of the polynucleotide, polynucleotides of the present disclosure. As a non-limiting example, in mice bearing a luciferease-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031; herein incorporated by reference in its entirety).

In some embodiments, the lipid nanoparticles can comprise a core of the polynucleotides disclosed herein and a polymer shell. The polymer shell can be any of the polymers described herein and are known in the art. In an additional embodiment, the polymer shell can be used to protect the polynucleotides in the core.

Core-shell nanoparticles for use with the polynucleotides of the present disclosure are described and can be formed by the methods described in U.S. Pat. No. 8,313,777 or International Patent Publication No. WO2013124867, the contents of each of which are herein incorporated by reference in their entirety.

In some embodiments, the core-shell nanoparticles can comprise a core of the polynucleotides disclosed herein and a polymer shell. The polymer shell can be any of the polymers described herein and are known in the art. In an additional embodiment, the polymer shell can be used to protect the polynucleotides in the core.

In some embodiments, the polymer used with the formulations described herein can be a modified polymer (such as, but not limited to, a modified polyacetal) as described in International Publication No. WO2011120053, the contents of which are herein incorporated by reference in its entirety.

In some embodiments, the formulation can be a polymeric carrier cargo complex comprising a polymeric carrier and at least one nucleic acid molecule. Non-limiting examples of polymeric carrier cargo complexes are described in International Patent Publications Nos. WO2013113326, WO2013113501, WO2013113325, WO2013113502 and WO2013113736 and European Patent Publication No. EP2623121, the contents of each of which are herein incorporated by reference in their entireties. In one aspect the polymeric carrier cargo complexes can comprise a negatively charged nucleic acid molecule such as, but not limited to, those described in International Patent Publication Nos. WO2013113325 and WO2013113502, the contents of each of which are herein incorporated by reference in its entirety.

In some embodiments, a pharmaceutical composition can comprise polynucleotides of the disclosure and a polymeric carrier cargo complex (See, e.g., the antigens described in International Patent Publications Nos. WO2013113326, WO2013113501, WO2013113325, WO2013113502 and WO2013113736 and European Patent Publication No. EP2623121, the contents of each of which are herein incorporated by reference in their entireties).

In some embodiments, the polymer used with the formulations described herein can be a modified polymer (such as, but not limited to, a modified polyacetal) as described in International Publication No. WO2011120053, the contents of which are herein incorporated by reference in its entirety Peptides and Proteins The disclosure also includes pharmaceutical compositions that comprise a formulation of the polynucleotide described herein, i.e., a polynucleotide comprising an ORF encoding an MCM polypeptide, using one or more peptides and/or proteins. The polynucleotides of the disclosure can be formulated with peptides and/or proteins in order to increase transfection of cells by the polynucleotide. In some embodiments, peptides such as, but not limited to, proteins and peptides that enable intracellular or mitochondrial delivery can be used to deliver pharmaceutical formulations.

Formulations of the disclosure including peptides or proteins can be used to increase cell transfection by the polynucleotide, alter the biodistribution of the polynucleotide (e.g., by targeting specific tissues or cell types), and/or increase the translation of encoded protein. (See e.g., International Pub. No. WO2012110636 and WO2013123298; the contents of which are herein incorporated by reference in its entirety).

In some embodiments, the cell penetrating peptide can be, but is not limited to, those described in US Patent Publication No US20130129726, US20130137644 and US20130164219, each of which is herein incorporated by reference in its entirety.

Self-Assembled Macromolecules

The disclosure also includes pharmaceutical compositions that comprise a formulation of the polynucleotide described herein, i.e., a polynucleotide comprising an ORF encoding an MCM polypeptide, with amphiphilic macromolecules (AMs) for delivery. AMs comprise biocompatible amphiphilic polymers that have an alkylated sugar backbone covalently linked to poly(ethylene glycol). In aqueous solution, the AMs self-assemble to form micelles. Non-limiting examples of methods of forming AMs and AMs are described in US Patent Publication No. US20130217753, the contents of which are herein incorporated by reference in its entirety.

Cations and Anions

The disclosure also includes pharmaceutical compositions that comprise a formulation of the polynucleotide described herein, i.e., a polynucleotide comprising an ORF encoding an MCM polypeptide, with cations or anions. In some embodiments, the formulations include metal cations such as, but not limited to, $Zn^{2+}$, $Ca^{2+}$, $Cu^{2+}$, $Mg+$ and combinations thereof. As a non-limiting example, formulations can include polymers and a polynucleotides complexed with a metal cation (see, e.g., U.S. Pat. Nos. 6,265,389 and 6,555,525, each of which is herein incorporated by reference in its entirety).

In some embodiments, cationic nanoparticles comprising combinations of divalent and monovalent cations can be formulated with polynucleotides. Such nanoparticles can form spontaneously in solution over a given period (e.g., hours, days, etc.). Such nanoparticles do not form in the presence of divalent cations alone or in the presence of monovalent cations alone. The delivery of polynucleotides in cationic nanoparticles or in one or more depot comprising cationic nanoparticles can improve polynucleotide bioavailability by acting as a long-acting depot and/or reducing the rate of degradation by nucleases.

Suspension Formulations

The disclosure also includes pharmaceutical compositions that comprise a formulation of the polynucleotide described herein, i.e., a polynucleotide comprising an ORF encoding an MCM polypeptide, in suspensions. In some embodiments, suspension formulations are provided comprising polynucleotides, water immiscible oil depots, surfactants and/or co-surfactants and/or co-solvents. Combinations of oils and surfactants can enable suspension formulation with polynucleotides. Delivery of polynucleotides in a water immiscible depot can be used to improve bioavailability through sustained release of mRNA from the depot to the surrounding physiologic environment and prevent polynucleotides degradation by nucleases.

In some embodiments, suspension formulations of mRNA can be prepared using combinations of polynucleotides, oil-based solutions and surfactants. Such formulations can be prepared as a two-part system comprising an aqueous phase comprising polynucleotides and an oil-based phase comprising oil and surfactants. Exemplary oils for suspension formulations can include, but are not limited to sesame oil and Miglyol (comprising esters of saturated coconut and palmkernel oil-derived caprylic and capric fatty acids and glycerin or propylene glycol), corn oil, soybean oil, peanut oil, beeswax and/or palm seed oil. Exemplary surfactants can include, but are not limited to Cremophor, polysorbate 20, polysorbate 80, polyethylene glycol, transcutol, Capmul®, labrasol, isopropyl myristate, and/or Span 80. In some embodiments, suspensions can comprise co-solvents including, but not limited to ethanol, glycerol and/or propylene glycol.

Suspensions can be formed by first preparing polynucleotides formulation comprising an aqueous solution of polynucleotide and an oil-based phase comprising one or more surfactants. Suspension formation occurs as a result of mixing the two phases (aqueous and oil-based). In some embodiments, such a suspension can be delivered to an aqueous phase to form an oil-in-water emulsion. In some embodiments, delivery of a suspension to an aqueous phase results in the formation of an oil-in-water emulsion in which the oil-based phase comprising polynucleotides forms droplets that can range in size from nanometer-sized droplets to micrometer-sized droplets. In some embodiments, specific combinations of oils, surfactants, cosurfactants and/or co-solvents can be utilized to suspend polynucleotides in the oil phase and/or to form oil-in-water emulsions upon delivery into an aqueous environment.

In some embodiments, suspensions can provide modulation of the release of polynucleotides into the surrounding environment. In such embodiments, polynucleotides release can be modulated by diffusion from a water immiscible depot followed by resolubilization into a surrounding environment (e.g., an aqueous environment).

In some embodiments, polynucleotides within a water immiscible depot (e.g., suspended within an oil phase) can result in altered polynucleotides stability (e.g., altered degradation by nucleases).

In some embodiments, polynucleotides can be formulated such that upon injection, an emulsion forms spontaneously (e.g., when delivered to an aqueous phase). Such particle formation can provide a high surface area to volume ratio for release of polynucleotides from an oil phase to an aqueous phase.

In some embodiments, the polynucleotides can be formulated in a nanoemulsion such as, but not limited to, the nanoemulsions described in U.S. Pat. No. 8,496,945, the contents of which are herein incorporated by reference in its entirety. The nanoemulsions can comprise nanoparticles described herein. As a non-limiting example, the nanoparticles can comprise a liquid hydrophobic core that can be surrounded or coated with a lipid or surfactant layer. The lipid or surfactant layer can comprise at least one membrane-integrating peptide and can also comprise a targeting ligand (see, e.g., U.S. Pat. No. 8,496,945, the contents of which are herein incorporated by reference in its entirety).

Semi-Solid Compositions

The disclosure also includes pharmaceutical compositions that comprise a formulation of the polynucleotide described herein, i.e., a polynucleotide comprising an ORF encoding an MCM polypeptide, in semi-solid compositions. In some embodiments, the polynucleotides can be formulated with a hydrophobic matrix to form a semi-solid composition. As a non-limiting example, the semi-solid composition or paste-like composition can be made by the methods described in International Patent Publication No WO201307604, herein incorporated by reference in its entirety. The semi-solid composition can be a sustained release formulation as described in International Patent Publication No WO201307604, herein incorporated by reference in its entirety.

In another embodiment, the semi-solid composition can further have a micro-porous membrane or a biodegradable polymer formed around the composition (see, e.g., International Patent Publication No WO201307604, herein incorporated by reference in its entirety).

The semi-solid composition using the polynucleotides of the present disclosure can have the characteristics of the semi-solid mixture as described in International Patent Publication No WO201307604, herein incorporated by reference in its entirety (e.g., a modulus of elasticity of at least $10^{-4}$ N·mm$^{-2}$, and/or a viscosity of at least 100 mPa·s).

Surgical Sealants: Gels and Hydrogels

The disclosure also includes pharmaceutical compositions that comprise a formulation of the polynucleotide described herein, i.e., a polynucleotide comprising an ORF encoding an MCM polypeptide, with surgical sealants. In some embodiments, the polynucleotides disclosed herein can be encapsulated into any hydrogel known in the art that can form a gel when injected into a subject. Surgical sealants such as gels and hydrogels are described in International Patent Application No. PCT/US2014/027077, the contents of which are herein incorporated by reference in its entirety.

Conjugates

The disclosure includes pharmaceutical compositions that comprise conjugates of the polynucleotide described herein, i.e., a polynucleotide comprising an ORF encoding an MCM polypeptide. The polynucleotides of the disclosure include conjugates, such as a polynucleotide covalently linked to a carrier or targeting group, or including two encoding regions that together produce a fusion protein (e.g., bearing a targeting group and therapeutic protein or peptide).

The conjugates of the disclosure include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand can also be a recombinant or synthetic molecule, such as a synthetic polymer, e.g., a synthetic polyamino acid, an oligonucleotide (e.g., an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, the conjugate of the present disclosure can function as a carrier for the polynucleotides of the present disclosure. The conjugate can comprise a cationic polymer such as, but not limited to, polyamine, polylysine, polyalkylenimine, and polyethylenimine that can be grafted to with poly(ethylene glycol). As a non-limiting example, the conjugate can be similar to the polymeric conjugate and the method of synthesizing the polymeric conjugate described in U.S. Pat. No. 6,586,524 herein incorporated by reference in its entirety.

A non-limiting example of a method for conjugation to a substrate is described in US Patent Publication No. US20130211249, the contents of which are herein incorporated by reference in its entirety. The method can be used to make a conjugated polymeric particle comprising a polynucleotide.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

As a non-limiting example, the targeting group can be a glutathione receptor (GR)-binding conjugate for targeted delivery across the blood-central nervous system barrier (See, e.g., US Patent Publication No. US2013021661012, the contents of which are herein incorporated by reference in its entirety.

In some embodiments, the conjugate of the present disclosure can be a synergistic biomolecule-polymer conjugate. The synergistic biomolecule-polymer conjugate can be long-acting continuous-release system to provide a greater therapeutic efficacy. The synergistic biomolecule-polymer conjugate can be those described in US Patent Publication No. US20130195799, the contents of which are herein incorporated by reference in its entirety.

In another embodiment, the conjugate that can be used in the present disclosure can be an aptamer conjugate. Non-limiting examples of aptamer conjugates are described in International Patent Publication No. WO2012040524, the contents of which are herein incorporated by reference in its entirety. The aptamer conjugates can be used to provide targeted delivery of formulations comprising polynucleotides.

In some embodiments, the conjugate that can be used in the present disclosure can be an amine containing polymer conjugate. Non-limiting examples of amine containing polymer conjugate are described in U.S. Pat. No. 8,507,653, the contents of which are herein incorporated by reference in its entirety.

In some embodiments, pharmaceutical compositions of the present disclosure can include chemical modifications such as, but not limited to, modifications similar to locked nucleic acids.

Representative U.S. patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the disclosure include polynucleotides with phosphorothioate backbones and oligonucleosides with other modified backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucleotides featured herein have morpholino backbone structures of the above-referenced U.S. Pat. No. 5,034,506.

Modifications at the 2' position can also aid in delivery. For example, modifications at the 2' position are not located in a polypeptide-coding sequence, i.e., not in a translatable region. Modifications at the 2' position can be located in a 5'UTR, a 3'UTR and/or a tailing region. Modifications at the 2' position can include one of the following at the 2' position: H (i.e., 2'-deoxy); F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. In other embodiments, the polynucleotides include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_3$)$_2$, also described in examples herein below. Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions, particularly the 3' position of the sugar on the 3' terminal nucleotide or in 2'-5' linked dsRNAs and the 5' position of 5' terminal nucleotide. Polynucleotides of the disclosure can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920; the contents of each of which is herein incorporated by reference in their entirety.

In still other embodiments, the polynucleotide is covalently conjugated to a cell penetrating polypeptide. The cell-penetrating peptide can also include a signal sequence or a targeting sequence. The conjugates of the disclosure can be designed to have increased stability; increased cell transfection; and/or altered the biodistribution (e.g., targeted to specific tissues or cell types).

In some embodiments, the polynucleotides can be conjugated to an agent to enhance delivery. As a non-limiting example, the agent can be a monomer or polymer such as a targeting monomer or a polymer having targeting blocks as described in International Publication No. WO2011062965, herein incorporated by reference in its entirety. In another non-limiting example, the agent can be a transport agent covalently coupled to the polynucleotides of the present disclosure (See, e.g., U.S. Pat. Nos. 6,835,393 and 7,374,778, each of which is herein incorporated by reference in its entirety). In yet another non-limiting example, the agent can be a membrane barrier transport enhancing agent such as those described in U.S. Pat. Nos. 7,737,108 and 8,003,129, each of which is herein incorporated by reference in its entirety.

In another embodiment, polynucleotides can be conjugated to SMARTT POLYMER TECHNOLOGY® (PHASERX®, Inc. Seattle, Wash.).

In another aspect, the conjugate can be a peptide that selectively directs the nanoparticle to neurons in a tissue or organism. As a non-limiting example, the peptide used can be, but is not limited to, the peptides described in US Patent Publication No US20130129627, herein incorporated by reference in its entirety.

In yet another aspect, the conjugate can be a peptide that can assist in crossing the blood-brain barrier.

Nanoparticle Formulations

Self-Assembled Nanoparticles

The disclosure also includes pharmaceutical compositions that comprise a formulation of the polynucleotide described herein, i.e., a polynucleotide comprising an ORF encoding an MCM polypeptide, with self-assembled nanoparticles. Nucleic acid self-assembled nanoparticles are described in International Patent Application No. PCT/US2014/027077, the contents of which are herein incorporated by reference in its entirety, such as in paragraphs [000740]-[000743]. Polymer-based self-assembled nanoparticles are described in International Patent Application No. PCT/US2014/027077, the contents of which are herein incorporated by reference in its entirety.

Nanoparticle Mimics

The disclosure includes pharmaceutical compositions that comprise a nanoparticle mimic formulation of the polynucleotide described herein, i.e., a polynucleotide comprising an ORF encoding an MCM polypeptide. In some embodiments, the polynucleotides of the disclosure is be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the polynucleotides of the disclosure can be encapsulated in a non-viron particle that can mimic the delivery function of a virus (see International Pub. No. WO2012006376 and US Patent Publication No. US20130171241 and US20130195968, the contents of each of which are herein incorporated by reference in its entirety).

Nanotubes

The disclosure includes pharmaceutical compositions that comprise a nanotube formulation of the polynucleotide described herein, i.e., a polynucleotide comprising an ORF encoding an MCM polypeptide. The polynucleotides of the disclosure can be attached or otherwise bound to at least one nanotube such as, but not limited to, rosette nanotubes, rosette nanotubes having twin bases with a linker, carbon nanotubes and/or single-walled carbon nanotubes, The polynucleotides can be bound to the nanotubes through forces such as, but not limited to, steric, ionic, covalent and/or other forces. Nanotubes and nanotube formulations comprising polynucleotides are described in International Patent Application No. PCT/US2014/027077, the contents of which are herein incorporated by reference in its entirety.

Inorganic Nanoparticles

The disclosure also includes pharmaceutical compositions that comprise a formulation of the polynucleotide described herein, i.e., a polynucleotide comprising an ORF encoding an MCM polypeptide, in inorganic nanoparticles. Example methods are provided in U.S. Pat. No. 8,257,745, herein incorporated by reference in its entirety. The inorganic nanoparticles can include, but are not limited to, clay substances that are water swellable. As a non-limiting example, the inorganic nanoparticle can include synthetic smectite clays that are made from simple silicates (See, e.g., U.S. Pat. Nos. 5,585,108 and 8,257,745 each of which are herein incorporated by reference in their entirety).

In some embodiments, the inorganic nanoparticles can comprise a core of the polynucleotides disclosed herein and a polymer shell. The polymer shell can be any of the polymers described herein and are known in the art. In an additional embodiment, the polymer shell can be used to protect the polynucleotides in the core.

Semi-Conductive and Metallic Nanoparticles

The disclosure also includes pharmaceutical compositions that comprise a formulation of the polynucleotide described herein, i.e., a polynucleotide comprising an ORF encoding an MCM polypeptide, with water-dispersible nanoparticles comprising a semiconductive or metallic material (U.S. Pub. No. 20120228565; herein incorporated by reference in its entirety) or formed in a magnetic nanoparticle (U.S. Pub. No. 20120265001 and 20120283503; each of which is herein incorporated by reference in its entirety). The water-dispersible nanoparticles can be hydrophobic nanoparticles or hydrophilic nanoparticles.

In some embodiments, the semi-conductive and/or metallic nanoparticles can comprise a core of the polynucleotides disclosed herein and a polymer shell. The polymer shell can be any of the polymers described herein and are known in the art. In an additional embodiment, the polymer shell can be used to protect the polynucleotides in the core.

Molded Nanoparticles and Microparticles

The disclosure also includes pharmaceutical compositions that comprise a formulation of the polynucleotide described herein, i.e., a polynucleotide comprising an ORF encoding an MCM polypeptide, in nanoparticles and/or microparticles. These nanoparticles and/or microparticles can be molded into any size shape and chemistry. As an example, the nanoparticles and/or microparticles can be made using the PRINT® technology by LIQUIDA TECHNOLOGIES® (Morrisville, N.C.) (See, e.g., International Pub. No. WO2007024323; the contents of which are herein incorporated by reference in its entirety).

In some embodiments, the molded nanoparticles can comprise a core of the polynucleotides disclosed herein and a polymer shell. The polymer shell can be any of the polymers described herein and are known in the art. In an additional embodiment, the polymer shell can be used to protect the polynucleotides in the core.

In some embodiments, the polynucleotides of the present disclosure can be formulated in microparticles. The microparticles can contain a core of the polynucleotides and a cortex of a biocompatible and/or biodegradable polymer. As a non-limiting example, the microparticles that can be used with the present disclosure can be those described in U.S. Pat. No. 8,460,709, U.S. Patent Publication No. US20130129830 and International Patent Publication No WO2013075068, each of which is herein incorporated by reference in its entirety. As another non-limiting example, the microparticles can be designed to extend the release of the polynucleotides of the present disclosure over a desired period of time (see, e.g., extended release of a therapeutic protein in U.S. Patent Publication No. US20130129830, herein incorporated by reference in its entirety).

The microparticle for use with the present disclosure can have a diameter of at least 1 micron to at least 100 microns (e.g., at least 1 micron, at least 5 micron, at least 10 micron, at least 15 micron, at least 20 micron, at least 25 micron, at least 30 micron, at least 35 micron, at least 40 micron, at least 45 micron, at least 50 micron, at least 55 micron, at least 60 micron, at least 65 micron, at least 70 micron, at least 75 micron, at least 80 micron, at least 85 micron, at least 90 micron, at least 95 micron, at least 97 micron, at least 99 micron, and at least 100 micron).

NanoJackets and NanoLiposomes

The disclosure also includes pharmaceutical compositions that comprise a formulation of the polynucleotide described herein, i.e., a polynucleotide comprising an ORF encoding an MCM polypeptide, with NanoJackets and NanoLiposomes by Keystone Nano (State College, Pa.). NanoJackets are made of compounds that are naturally found in the body including calcium, phosphate and can also include a small amount of silicates. Nanojackets can range in size from 5 to 50 nm and can be used to deliver hydrophilic and hydrophobic compounds such as, but not limited to, polynucleotides.

NanoLiposomes are made of lipids such as, but not limited to, lipids that naturally occur in the body. NanoLiposomes can range in size from 60-80 nm and can be used to deliver hydrophilic and hydrophobic compounds such as, but not limited to, polynucleotides. In one aspect, the polynucleotides disclosed herein are formulated in a Nano-Liposome such as, but not limited to, Ceramide NanoLiposomes. Cells The disclosure also includes cells that comprise a polynucleotide described herein, i.e., a polynucleotide comprising an ORF encoding an MCM polypeptide. The polynucleotides of the disclosure can be transfected ex vivo into cells, which are subsequently transplanted into a subject. As non-limiting examples, the pharmaceutical compositions can include red blood cells to deliver modified RNA to liver and myeloid cells, virosomes to deliver modified RNA in virus-like particles (VLPs), and electroporated cells such as, but not limited to, from MAXCYTE® (Gaithersburg, Md.) and from ERYTECH® (Lyon, France) to deliver modified RNA. Examples of use of red blood cells, viral particles and electroporated cells to deliver payloads other than polynucleotides have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

The polynucleotides can be delivered in synthetic VLPs synthesized by the methods described in International Pub No. WO2011085231 and WO2013116656 and US Pub No. 20110171248, the contents of each of which are herein incorporated by reference in their entireties.

Cell-based formulations of the polynucleotides of the disclosure can be used to ensure cell transfection (e.g., in the cellular carrier), alter the biodistribution of the polynucleotide (e.g., by targeting the cell carrier to specific tissues or cell types), and/or increase the translation of encoded protein.

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of the cell plasma membrane. Sonoporation methods are known to those in the art and are used to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; all herein incorporated by reference in their entirety). Sonoporation methods are known in the art and are also taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art and are used to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). Electroporation devices are sold by many companies worldwide including, but not limited to BTX® Instruments (Holliston, Mass.) (e.g., the AgilePulse In Vivo System) and Inovio (Blue Bell, Pa.) (e.g., Inovio SP-5P intramuscular delivery device or the CELLECTRA® 3000 intradermal delivery device). In some embodiments, polynucleotides can be delivered by electroporation.

In some embodiments, the cells are selected from the group consisting of mammalian cells, bacterial cells, plant, microbial, algal and fungal cells. In some embodiments, the cells are mammalian cells, such as, but not limited to, human, mouse, rat, goat, horse, rabbit, hamster or cow cells. In a further embodiment, the cells can be from an established cell line, including, but not limited to, HeLa, NSO, SP2/0, KEK 293T, Vero, Caco, Caco-2, MDCK, COS-1, COS-7, K562, Jurkat, CHO-K1, DG44, CHOK1SV, CHO-S, Huvec, CV-1, Huh-7, NIH3T3, HEK293, 293, A549, HepG2, IMR-90, MCF-7, U-20S, Per.C6, SF9, SF21 or Chinese Hamster Ovary (CHO) cells.

In certain embodiments, the cells are fungal cells, such as, but not limited to, *Chrysosporium* cells, *Aspergillus* cells, *Trichoderma* cells, *Dictyostelium* cells, *Candida* cells, *Saccharomyces* cells, *Schizosaccharomyces* cells, and *Penicillium* cells.

In certain embodiments, the cells are bacterial cells such as, but not limited to, *E. coli*, *B. subtilis*, or BL21 cells. Primary and secondary cells to be transfected by the methods of the disclosure can be obtained from a variety of tissues and include, but are not limited to, all cell types that can be maintained in culture. For examples, primary and secondary cells that can be transfected by the methods of the disclosure include, but are not limited to, fibroblasts, keratinocytes, epithelial cells (e.g., mammary epithelial cells, intestinal epithelial cells), endothelial cells, glial cells, neural cells, formed elements of the blood (e.g., lymphocytes, bone marrow cells), muscle cells and precursors of these somatic cell types. Primary cells can also be obtained from a donor of the same species or from another species (e.g., mouse, rat, rabbit, cat, dog, pig, cow, bird, sheep, goat, horse).

Minicells

The disclosure also includes minicells that comprise a polynucleotide described herein, i.e., a polynucleotide comprising an ORF encoding an MCM polypeptide. In one aspect, the polynucleotides can be formulated in bacterial minicells. As a non-limiting example, bacterial minicells can be those described in International Publication No. WO2013088250 or US Patent Publication No. US20130177499, the contents of each of which are herein incorporated by reference in its entirety.

Micro-Organs

The disclosure also includes micro-organs containing a polynucleotide described herein, i.e., a polynucleotide comprising an ORF encoding an MCM polypeptide. The polynucleotides can be contained in a micro-organ that can then express an encoded polypeptide of interest in a long-lasting therapeutic formulation. Micro-organs and formulations thereof are described in International Patent Application No. PCT/US2014/027077, the contents of which are herein incorporated by reference in its entirety.

Exosomes

The disclosure also includes pharmaceutical compositions that comprise a formulation of the polynucleotide described herein, i.e., a polynucleotide comprising an ORF encoding an MCM polypeptide, in exosomes. The exosomes can be loaded with at least one polynucleotide and delivered to cells, tissues and/or organisms. As a non-limiting example, the polynucleotides can be loaded in the exosomes described in International Publication No. WO2013084000, herein incorporated by reference in its entirety.

Pseudovirions

The disclosure also includes pharmaceutical compositions that comprise a formulation of the polynucleotide described herein, i.e., a polynucleotide comprising an ORF encoding an MCM polypeptide, in in Pseudovirions (e.g., pseudovirions). As a non-limiting example, the pseudovirions can be those developed and/or are described by Aura Biosciences (Cambridge, Mass.). In one aspect, the pseudovirion can be developed to deliver drugs to keratinocytes and basal membranes (See e.g., US Patent Publication Nos. US20130012450, US20130012566, US21030012426 and US20120207840 and International Publication No. WO2013009717, each of which is herein incorporated by reference in its entirety).

In some embodiments, the pseudovirion used for delivering the polynucleotides of the present disclosure can be derived from viruses such as, but not limited to, herpes and papillomaviruses (See, e.g., US Patent Publication Nos. US Patent Publication Nos. US20130012450, US20130012566, US21030012426 and US20120207840 and International Publication No. WO2013009717, each of which is herein incorporated by reference in its entirety; and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Pseudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Pseudovirion Carrying the HSV-tk Gene. PLoS ONE. 2012: 7(7) e40983; Johnson et al., Role of Heparan Sulfate in Attachment to and Infection of the Murine Female Genital Tract by Human Papillomavirus. J Virology. 2009: 83(5) 2067-2074; each of which is herein incorporated by reference in its entirety).

The pseudovirion can be a virus-like particle (VLP) prepared by the methods described in US Patent Publication No. US20120015899 and US20130177587 and International Patent Publication No. WO2010047839 WO2013116656, WO2013106525 and WO2013122262, the contents of each of which is herein incorporated by reference in its entirety. In one aspect, the VLP can be, but is not limited to, bacteriophages MS, Qβ, R17, fr, GA, Sp, MI, I, MXI, NL95, AP205, f2, PP7, and the plant viruses Turnip crinkle virus (TCV), Tomato bushy stunt virus (TBSV), Southern bean mosaic virus (SBMV) and members of the genus Bromovirus including Broad bean mottle virus, Brome mosaic virus, Cassia yellow blotch virus, Cowpea chlorotic mottle virus (CCMV), Melandrium yellow fleck virus, and Spring beauty latent virus. In another aspect, the VLP can be derived from the influenza virus as described in US Patent Publication No. US20130177587 or U.S. Pat. No. 8,506,967, the contents of each of which are herein incorporated by reference in its entirety. In yet another aspect, the VLP can comprise a B7-1 and/or B7-2 molecule anchored to a lipid membrane or the exterior of the particle such as described in International Patent Publication No. WO2013116656, the contents of which are herein incorporated by reference in its entirety. In one aspect, the VLP can be derived from norovirus, rotavirus recombinant VP6 protein or double layered VP2/VP6 such as the VLP described in International Patent Publication No. WO2012049366, the contents of which are herein incorporated by reference in its entirety.

The pseudovirion can be a human papilloma virus-like particle such as, but not limited to, those described in International Publication No. WO2010120266 and US Patent Publication No. US20120171290, each of which is herein incorporated by reference in its entirety and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Pseudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Pseudovirion Carrying the HSV-tk Gene. PLoS ONE. 2012: 7(7) e40983; Johnson et al., Role of Heparan Sulfate in Attachment to and Infection of the Murine Female Genital Tract by Human Papillomavirus. J Virology. 2009: 83(5) 2067-2074; each of which is herein incorporated by reference in its entirety.

In one aspect, the pseudovirions can be virion derived nanoparticles such as, but not limited to, those described in US Patent Publication No. US20130116408 and US20130115247, each of which is herein incorporated by reference in their entirety. The virion derived nanoparticles can be made by the methods described in US Patent Publication No. US20130116408 and US20130115247 or International Patent Publication No. WO2013119877, each of which is herein incorporated by reference in their entirety.

In some embodiments, the virus-like particle (VLP) can be a self-assembled particle. Non-limiting examples of self-assembled VLPs and methods of making the self-assembled VLPs are described in International Patent Publication No. WO2013122262, the contents of which are herein incorporated by reference in its entirety.

Silk-Based Delivery

The disclosure also includes pharmaceutical compositions that are formulated for silk-based delivery of the polynucleotides described herein, i.e., a polynucleotide comprising an ORF encoding an MCM polypeptide. In some embodiments, the polynucleotides can be formulated in a sustained release silk-based delivery system. The silk-based delivery system can be formed by contacting a silk fibroin solution with a therapeutic agent such as, but not limited to, the polynucleotides described herein and/or known in the art. As a non-limiting example, the sustained release silk-based delivery system that can be used in the present disclosure and methods of making such system are described in US Patent Publication No. US20130177611, the contents of which are herein incorporated by reference in its entirety.

Microparticles

The disclosure includes pharmaceutical compositions that comprise a microparticle formulation of the polynucleotide described herein, i.e., a polynucleotide comprising an ORF encoding an MCM polypeptide. In some embodiments, formulations comprising polynucleotides can comprise microparticles. The microparticles can comprise a polymer described herein and/or known in the art such as, but not limited to, poly(α-hydroxy acid), a polyhydroxy butyric acid, a polycaprolactone, a polyorthoester and a polyanhydride. The microparticle can have adsorbent surfaces to adsorb biologically active molecules such as polynucleotides. As a non-limiting example microparticles for use with the present disclosure and methods of making microparticles are described in US Patent Publication No. US2013195923 and US20130195898 and U.S. Pat. Nos. 8,309,139 and 8,206,749, the contents of each of which are herein incorporated by reference in its entirety.

In another embodiment, the formulation can be a microemulsion comprising microparticles and polynucleotides. As a non-limiting example, microemulsions comprising microparticles are described in US Patent Publication No. US2013195923 and US20130195898 and U.S. Pat. Nos. 8,309,139 and 8,206,749, the contents of each of which are herein incorporated by reference in its entirety.

Microvesicles

The disclosure includes pharmaceutical compositions that comprise a microvesicle-based formulation of the polynucleotide described herein, i.e., a polynucleotide comprising an ORF encoding an MCM polypeptide. In some embodiments, polynucleotides can be formulated in microvesicles. Non-limiting examples of microvesicles include those described in US Patent Publication No. US20130209544, the contents of which are herein incorporated by reference in its entirety.

In some embodiments, the microvesicle is an ARRDC1-mediated microvesicles (ARMMs). Non-limiting examples of ARMMs and methods of making ARMMs are described in International Patent Publication No. WO2013119602, the contents of which are herein incorporated by reference in its entirety.

Interpolyelectrolyte Complexes

The disclosure also includes pharmaceutical compositions that comprise a formulation of the polynucleotide described herein, i.e., a polynucleotide comprising an ORF encoding an MCM polypeptide, in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368, the contents of which is herein incorporated by reference in its entirety.

Crystalline Polymeric Systems

The disclosure also includes pharmaceutical compositions that comprise a formulation of the polynucleotide described herein, i.e., a polynucleotide comprising an ORF encoding an MCM polypeptide, in crystalline polymeric systems. Crystalline polymeric systems are polymers with crystalline moieties and/or terminal units comprising crystalline moieties. Non-limiting examples of polymers with crystalline moieties and/or terminal units comprising crystalline moieties termed "CYC polymers," crystalline polymer systems and methods of making such polymers and systems are described in U.S. Pat. No. 8,524,259, the contents of which are herein incorporated by reference in its entirety.

Cryoprotectants for mRNA

The disclosure also includes pharmaceutical compositions that comprise a formulation of the polynucleotide described herein, i.e., a polynucleotide comprising an ORF encoding an MCM polypeptide, with cyroprotectants. As used herein, there term "cryoprotectant" refers to one or more agent that when combined with a given substance, helps to reduce or eliminate damage to that substance that occurs upon freezing. In some embodiments, cryoprotectants are combined with polynucleotides in order to stabilize them during freezing. Frozen storage of mRNA between −20° C. and −80° C. can be advantageous for long term (e.g., 36 months) stability of polynucleotide. In some embodiments, cryoprotectants are included in polynucleotide formulations to stabilize polynucleotide through freeze/thaw cycles and under frozen storage conditions. Cryoprotectants of the present disclosure can include, but are not limited to sucrose, trehalose, lactose, glycerol, dextrose, raffinose and/or mannitol. Trehalose is listed by the Food and Drug Administration as being generally regarded as safe (GRAS) and is commonly used in commercial pharmaceutical formulations.

Bulking Agents

The disclosure also includes pharmaceutical compositions that comprise a formulation of the polynucleotide described herein, i.e., a polynucleotide comprising an ORF encoding an MCM polypeptide, with bulking agents. As used herein, the term "bulking agent" refers to one or more agents included in formulations to impart a desired consistency to the formulation and/or stabilization of formulation components. In some embodiments, bulking agents are included in lyophilized polynucleotide formulations to yield a "pharmaceutically elegant" cake, stabilizing the lyophilized polynucleotides during long term (e.g., 36 month) storage. Bulking agents of the present disclosure can include, but are not limited to sucrose, trehalose, mannitol, glycine, lactose and/or raffinose. In some embodiments, combinations of cryoprotectants and bulking agents (for example, sucrose/glycine or trehalose/mannitol) can be included to both stabilize polynucleotides during freezing and provide a bulking agent for lyophilization.

Non-limiting examples of formulations and methods for formulating the polynucleotides of the present disclosure are also provided in International Publication No WO2013090648 filed Dec. 14, 2012, the contents of which are incorporated herein by reference in their entirety.

Inactive Ingredients

The disclosure also includes pharmaceutical compositions that comprise a formulation of the polynucleotide described herein, i.e., a polynucleotide comprising an ORF encoding an MCM polypeptide, with at least one excipient that is an inactive ingredient. As used herein, the term "inactive ingredient" refers to one or more inactive agents included in formulations. In some embodiments, all, none or some of the inactive ingredients that can be used in the formulations of the present disclosure can be approved by the US Food and Drug Administration (FDA). A non-exhaustive list of inactive ingredients and the routes of administration the inactive ingredients can be formulated in are described in International Application No. PCT/US2014/027077.

VII. Method of Use of Polynucleotides

The polynucleotides of the present disclosure (i.e., a polynucleotide comprising an ORF encoding an MCM polypeptide) can be administered by any route that results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration that is then covered by a dressing that occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions can be administered in a way that allows them cross the blood-brain barrier, vascular barrier, or other epithelial barrier. In some embodiments, a formulation for a route of administration can include at least one inactive ingredient.

The polynucleotides of the present disclosure can be delivered to a cell naked. As used herein in, "naked" refers to delivering polynucleotides free from agents that promote transfection. For example, the polynucleotides delivered to the cell can contain no modifications. The naked polynucleotides can be delivered to the cell using routes of administration known in the art and described herein.

The polynucleotides of the present disclosure can be formulated, using the methods described herein. The formulations can contain polynucleotides that can be modified and/or unmodified. The formulations can further include, but are not limited to, cell penetration agents, a pharmaceutically acceptable carrier, a delivery agent, a bioerodible or biocompatible polymer, a solvent, and a sustained-release delivery depot. The formulated polynucleotides can be delivered to the cell using routes of administration known in the art and described herein.

The compositions can also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

Parenteral and Injectable Administration

The present disclosure encompasses the delivery of polynucleotides of the disclosure (i.e., a polynucleotide comprising an ORF encoding an MCM polypeptide) in forms suitable for parenteral and injectable administration. Liquid dosage forms for parenteral administration include, but are not limited to, pharmaceutically acceptable emulsions, microemulsions, solutions, suspensions, syrups, and/or elixirs. In addition to active ingredients, liquid dosage forms can comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

A pharmaceutical composition for parenteral administration can comprise at least one inactive ingredient. Any or none of the inactive ingredients used can have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions can be formulated according to the known art using suitable dispersing agents, wetting agents, and/or suspending agents. Sterile injectable preparations can be sterile injectable solutions, suspensions, and/or emulsions in nontoxic parenterally acceptable diluents and/or solvents, for example, as a solution in 1,3-butanediol. Among the acceptable vehicles and solvents that can be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation can also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions that can be dissolved or dispersed in sterile water or other sterile injectable medium prior to use.

Injectable formulations can be for direct injection into a region of a tissue, organ and/or subject. As a non-limiting example, a tissue, organ and/or subject can be directly injected a formulation by intramyocardial injection into the ischemic region. (See, e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This can be accomplished by the use of a liquid suspension of crystalline or amorphous material with poor water solubility. The rate of absorption of the drug then depends upon its rate of dissolution which, in turn, can depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions that are compatible with body tissues.

Therapeutic Use

The polynucleotides of the present disclosure are used in the preparation, manufacture and therapeutic use of polynucleotide molecules comprising an mRNA encoding a methylmalonyl-CoA mutase (MCM) polypeptide. In some embodiments, the polynucleotides of the present disclosure can be used to treat and/or prevent MCM-related diseases, disorders or conditions. Typically, but not exclusively, the polynucleotides of the present disclosure can be used to treat and/or prevent methylmalonic acidemia. In some embodiments, the nucleotides are used in methods for reducing the levels of methylmalonic acid in a subject in need thereof. For instance, one aspect of the disclosure provides a method of alleviating the symptoms of methylmalonic acidemia in a subject via the administration of a composition comprising a polynucleotide encoding MCM to that subject.

In some embodiments, the polynucleotides of the present disclosure are used to reduce the level of a metabolite associated with methylmalonic acidemia, the method comprising administering to the subject an effective amount of a polynucleotide encoding an MCM polypeptide. In some embodiments, the administration of an effective amount of a polynucleotide reduces the levels of a biomarker of methylmalonic acidemia such as methylmalonic acid, propionyl-carnitine, acetyl-carnitine, propionyl-CoA, D-methylmalonyl-CoA, L-methylmalonyl-CoA, or a combination thereof in a subject. In some embodiments, the administration of the polynucleotide results in reduction in the level of one or more biomarkers of methylmalonic acidemia within a short period of time after administration of the polynucleotide.

In some embodiments, the administration of the polynucleotide results in expression of methylmalonyl-CoA mutase in cells of the subject. In some embodiments, administering the polynucleotide results in an increase of MCM enzymatic activity in the subject. For example, in some embodiments, the polynucleotides of the present disclosure are used in methods of administering a composition comprising an mRNA encoding MCM to a subject, wherein the method results in an increase of MCM enzymatic activity in at least some cells of a subject. In some embodiments, the administration of a composition comprising an mRNA encoding MCM to a subject results in an increase of MCM enzymatic activity in cells of subject by at least 10%, at least 25%, at least 50%, at least 75%, at least 100%, or by more than 100%. In some embodiments, the administration of a composition comprising an mRNA encoding MCM to a subject results in an increase of MCM enzymatic activity in cells subject to a level at least 10%, at least 20%, at least 30%, at least 40%, at least 50%, at least 60%, at least 70%, at least 80%, at least 90%, or to 100% or more of the activity level expected in a normal subject, e.g., a normal human not suffering from MMA. In some embodiments, the administration of the polynucleotide results in expression of methylmalonyl-CoA mutase in at least some of the cells of a subject that persists for a period of time sufficient to allow significant methylmalonyl-CoA metabolism to occur.

In some embodiments, the expression of the encoded polypeptide is increased. In some embodiments, the IVT polynucleotide increases MCM expression levels in cells when introduced into those cells, e.g., by 20-50%, at least 20%, at least 25%, at least 30%, at least 35%, at least 40%, at least 45%, or at least 50%.

In some embodiments, the method or use comprises administering a polynucleotide, e.g., mRNA, comprising an ORF having significant sequence similarity to a polynucleotide selected from the group of SEQ ID NOs: 1-207, 732-765, and 772, wherein the ORF encodes an MCM polypeptide. Other aspects of the present disclosure relate to transplantation of cells containing polynucleotides to a mammalian subject. Administration of cells to mammalian subjects is known to those of ordinary skill in the art, and includes, but is not limited to, local implantation (e.g., topical or subcutaneous administration), organ delivery or systemic injection (e.g., intravenous injection or inhalation), and the formulation of cells in pharmaceutically acceptable carriers. Such compositions containing polynucleotides can be formulated for administration intramuscularly, transarterially, intraperitoneally, intravenously, intranasally, subcutaneously, endoscopically, transdermally, or intrathecally.

In some embodiments, the composition can be formulated for extended release.

In some embodiments, the present methods are able to catalyze the conversion of at least 0.1%, 0.5%, 1%, 2%, 2.5%, 5%, 10%, 20%, 25%, 30%, 35% 40%, 45%, 50%, 55%, 60%, 65%, 70%, 75%, 80%, 85% or more of L-methylmalonyl-CoA to succinyl-CoA. In some embodiments, a the methods are able to catalyze the conversion of a range of from 0.1% to 5%, 5% to 25%, 10% to 25%, 10% to 30%, 20% to 40%, 10% to 50%, 20% to 50%, 10% to 75%, 20% to 75%, 30% to 75%, 30% to 85%, or 25% to 100% of L-methylmalonyl-CoA to succinyl-CoA.

In some embodiments, the methods achieve at least 0.1%, 0.5%, 1%, 2%, 2.5%, 5%, 10%, 20%, 25%, 30%, 35% 40%, 45%, 50%, 55%, 60%, 65%, 70%, 75%, 80%, 85% or more of the enzymatic activity sufficient for the synthesis of AdoCbl. In some embodiments, the methods achieve a range of from 0.1% to 5%, 5% to 25%, 10% to 25%, 10% to 30%, 20% to 40%, 10% to 50%, 20% to 50%, 10% to 75%, 20% to 75%, 30% to 75%, 30% to 85%, or 25% to 100% of the enzymatic activity sufficient for the synthesis of Adenosylcobalamin (AdoCbl).

In some embodiments, the methods achieve sufficient enzymatic activity to synthesize at least 0.1%, 0.5%, 1%, 2%, 2.5%, 5%, 10%, 20%, 25%, 30%, 35% 40%, 45%, 50%, 55%, 60%, 65%, 70%, 75%, 80%, 85% or more of the active form of Adenosylcobalamin (AdoCbl), found in healthy individuals. In some embodiments, the methods achieve sufficient enzymatic activity to synthesize a range of from 0.1% to 5%, 5% to 25%, 10% to 25%, 10% to 30%, 20% to 40%, 10% to 50%, 20% to 50%, 10% to 75%, 20% to 75%, 30% to 75%, 30% to 85%, or 25% to 100% of the active form of AdoCbl found in healthy individuals.

In some embodiments, the methods involve the administration of a polynucleotide in combination with another therapy to a patient in need thereof. Such methods can involve administering a polynucleotide prior to, concurrent with, or subsequent to administration of the additional therapy. In some embodiments, such methods have an additive or synergistic effect. In some embodiments, presented herein is a method for treating MMA, comprising administering to a patient in need thereof an effective amount of a polynucleotide (e.g., mRNA) encoding an MCM polypeptide and an effective amount of another therapy. Examples of such other therapies include, but are not limited to, cobalamin supplements, carnitine supplements and antibiotics. In another specific embodiment, presented herein is a method for treating MMA, comprising administering to a patient in need thereof an effective amount of a polynucleotide (e.g., mRNA) encoding an MCM polypeptide and maintaining a low-protein diet.

In some embodiments, the concentration of methylmalonic acid in biological specimens (e.g., blood, plasma, serum, cerebral spinal fluid, urine, or any other biofluids) of a patient is monitored before, during and/or after a course of treatment involving the administration of a polynucleotide (e.g., mRNA) encoding an MCM polypeptide or a pharmaceutical composition thereof to the patient. In some embodiments, the concentration of methylcitrate in biological specimens (e.g., urine, blood, plasma, serum, cerebral spinal fluid, or any other biofluids) of a patient is monitored before, during and/or after a course of treatment involving the administration of a polynucleotide (e.g., mRNA) encoding an MCM polypeptide or a pharmaceutical composition thereof to the patient. In some embodiments, the concentration of propionylcarnitine in biological specimens (e.g., blood, plasma, serum, cerebral spinal fluid, urine, or any other biofluids) of a patient is monitored before, during and/or after a course of treatment involving the administration of a polynucleotide (e.g., mRNA) encoding an MCM polypeptide or a pharmaceutical composition thereof to the patient. In some embodiments, erythrocyte odd long-chain fatty acids (OLCFAs) levels are monitored before, during and/or after a course of treatment involving the administration of a polynucleotide (e.g., mRNA) encoding an MCM polypeptide or a pharmaceutical composition thereof to a patient. In some embodiments, the urinary urea:methylmalonic acid ratio is monitored before, during and/or after a course of treatment involving the administration of a polynucleotide (e.g., mRNA) encoding an MCM polypeptide or a pharmaceutical composition thereof to a patient. The dosage, frequency and/or length of administration of a polynucleotide (e.g., mRNA) encoding an MCM polypeptide or a pharmaceutical composition thereof to a patient may be modified as a result of the concentration of methylmalonic acid, methylcitrate, or propionylcarnitine, erythrocyte odd long-chain fatty acids (OLCFAs) levels, or the urinary urea:methylmalonic acid ratio. Alternatively, changes in one or more of these monitoring parameters (e.g., concentration of methylmalonic acid, methylcitrate, or propionylcarnitine, erythrocyte odd long-chain fatty acids (OLCFAs) levels, or the urinary urea:methylmalonic acid ratio) might indicate that the course of treatment involving the administration of the polynucleotide (e.g., mRNA) encoding an MCM polypeptide or pharmaceutical composition thereof is effective in treating MMA.

In a specific embodiment, presented herein is a method for treating MMA, comprising: (a) administering to a patient in need thereof one or more doses of a polynucleotide (e.g., mRNA) encoding an MCM polypeptide or a pharmaceutical composition thereof; and (b) monitoring the concentration of methylmalonic acid, methylcitrate, or propionylcarnitine (e.g., detected in biological specimens such as plasma, serum, cerebral spinal fluid, urine, or other biofluids), erythrocyte odd long-chain fatty acids (OLCFAs) levels, or the urinary urea:methylmalonic acid ratio before and/or after step (a). In some embodiments, step (b) comprises monitoring the concentration of methylmalonic acid. In some embodiments, step (b) comprises monitoring the concentration of methylmalonic acid, methylcitrate and/or propionylcarnitine. In some embodiments, the monitoring step (b) is carried out before and/or after a certain number of doses (e.g., 1, 2, 4, 6, 8, 10, 12, 14, 15, or 20 doses, or more doses; or 2 to 4, 2 to 8, 2 to 20 or 2 to 30 doses) or after a certain time period (e.g., 1, 2, 3, 4, 5, 6, or 7 days; or 1, 2, 3, 4, 5, 10, 15, 20, 30, 40, 45, 48, or 50 weeks) of administering the polynucleotide (e.g., mRNA) encoding an MCM polypeptide. In some embodiments, one or more of these monitoring parameters are detected prior to administration of the polynucleotide (e.g., mRNA) encoding an MCM polypeptide or pharmaceutical composition thereof. In some embodiments, a decrease in the concentration of methylmalonic acid, methylcitrate, or propionylcarnitine, or a decrease in erythrocyte odd long-chain fatty acids (OLCFAs) levels following administration of the polynucleotide or pharmaceutical composition thereof indicates that the course of treatment is effective for treating MMA. In some embodiments, an increase in the urinary urea:methylmalonic acid ratio following administration of the polynucleotide (e.g., mRNA) encoding an MCM polypeptide or pharmaceutical composition thereof indicates that the course of treatment is effective for treating MMA.

The concentration of methylmalonic acid, methylcitrate, or propionylcarnitine, erythrocyte odd long-chain fatty acids (OLCFAs) levels, or the urinary urea:methylmalonic acid ratio of a patient may be detected by any technique known to one of skill in the art. In some embodiments, the method for detecting the concentration of methylmalonic acid, methylcitrate, or propionylcarnitine in a patient involves obtaining a tissue or fluid sample from the patient and detecting the concentration of methylmalonic acid, methylcitrate, propionylcarnitine or urea in the biological sample (e.g., from plasma serum sample, cerebral spinal fluid, urine, or other biofluids) that has been subjected to certain types of treatment (e.g., centrifugation) and detection by use of, e.g., standard gas chromatography/mass spectroscopy (GC/MS) stable-isotope dilution methods, positive chemical ionization gas chromatography mass spectrometry (CI GC-MS)

spectroscopic techniques (e.g., UV spectroscopy) or high pressure liquid chromatography (HPLC).

In some embodiments, the methods for treating MMA provided herein alleviate or manage one, two or more symptoms associated with MMA. Alleviating or managing one, two or more symptoms of MMA may be used as a clinical endpoint for efficacy of a polynucleotide for treating MMA. In some embodiments, the methods for treating MMA provided herein reduce the duration and/or severity of one or more symptoms associated with MMA. In some embodiments, the methods for treating MMA provided herein inhibit the onset, progression and/or recurrence of one or more symptoms associated with MMA. In some embodiments, the methods for treating MMA provided herein reduce the number of symptoms associated with MMA. In some embodiments, the methods for treating MMA provided herein inhibit or reduce the progression of one or more symptoms associated therewith.

Symptoms associated with MMA include, but are not limited to: apnea, hyperammonemia, metabolic acidosis, lethargy, vomiting, dehydration, hypotonia, hypoglycemia, repeated yeast infections, renal impairment, mental retardation, developmental delays, seizures, movement disorders, progressive encephalopathy, facial dysmorphism (e.g., high forehead, broad nasal bridge, epicanthal folds, long smooth philtrum, or triangular mouth), stroke, skin lesions (e.g., moniliasis), occasional hepatomegaly, acute onset of choreoathetosis, dystonia, dysphagia, dysarthria, growth problems (e.g., growth failure), kidney disease or failure, tissue damage, feeding problems, cognitive disabilities, metabolic attacks triggered by common infections and reduced glomerular filtration rate (GFR).

In some embodiments, the methods for treating MMA provided herein reduce or eliminate one, two, or more of the following: metabolic acidosis, developmental delays, movement disorders, metabolic decompensation episodes (e.g., frequency and/or numbers of episodes), skin lesions, hypotonia, seizures, and renal impairment, associated with MMA. In some embodiments, the methods for treating MMA provided herein improve renal function, development, cognitive ability and movement in a patient diagnosed with MMA.

In some embodiments, the methods for treating MMA provided herein reduce hospitalization (e.g., the frequency or duration of hospitalization) of a patient diagnosed with MMA. In some embodiments, the methods for treating MMA provided herein reduce hospitalization length of a patient diagnosed with MMA. In some embodiments, the methods for treating MMA provided herein decrease the hospitalization rate.

In some embodiments, the methods provided herein increase the survival of a patient diagnosed with MMA. In some embodiments, the methods for treating MMA provided herein reduce the mortality of subjects diagnosed with MMA. In some embodiments, the methods for treating MMA provided herein increase symptom-free survival of MMA patients. In some embodiments, the methods for treating MMA provided herein do not cure MMA in patients, but prevent the progression or worsening of the disease. In some embodiments, the methods for treating MMA provided herein enhance or improve the therapeutic effect of another therapy.

In some embodiments, the methods for treating MMA provided herein reduce the concentration of plasma methylmalonic acid in a subject by at least about 5%, 10%, 15%, 20%, 25%, 30%, 35%, 40%, 45%, 50%, 55%, 60%, 65%, 80%, 85%, 90%, 95%, or 100%, or in a range of from 5% to 50%, 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein. In some embodiments, the methods for treating MMA provided herein reduce the concentration of urinary methylmalonic acid in a subject by at least about 5%, 10%, 15%, 20%, 25%, 30%, 35%, 40%, 45%, 50%, 55%, 60%, 65%, 80%, 85%, 90%, 95%, or 100%, or in a range of from 5% to 50%, 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein.

In some embodiments, the methods for treating MMA provided herein reduce the concentration of a metabolite of methylmalonic acid in a subject by at least about 5%, 10%, 15%, 20%, 25%, 30%, 35%, 40%, 45%, 50%, 55%, 60%, 65%, 80%, 85%, 90%, 95%, or 100%, or in a range of from 5% to 50%, 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein. In some embodiments, the methods for treating MMA provided herein reduce the concentration of plasma propionylcamitine in a subject by at least about 5%, 10%, 15%, 20%, 25%, 30%, 35%, 40%, 45%, 50%, 55%, 60%, 65%, 80%, 85%, 90%, 95%, or 100%, or in a range of from 5% to 50%, 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein. In some embodiments, the methods for treating MMA provided herein reduce the concentration of urinary methylcitrate in a subject by at least about 5%, 10%, 15%, 20%, 25%, 30%, 35%, 40%, 45%, 50%, 55%, 60%, 65%, 80%, 85%, 90%, 95%, or 100%, or in a range of from 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein.

In some embodiments, the methods for treating MMA provided herein reduce the erythrocyte odd-numbered long-chain fatty acids levels in a subject by at least about 5%, 10%, 15%, 20%, 25%, 30%, 35%, 40%, 45%, 50%, 55%, 60%, 65%, 80%, 85%, 90%, 95%, or 100%, or in a range of from 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein. In some embodiments, the methods for treating MMA provided herein increase the urinary urea:methylmalonic acid ratio in a subject by at least about 5%, 10%, 15%, 20%, 25%, 30%, 35%, 40%, 45%, 50%, 55%, 60%, 65%, 80%, 85%, 90%, 95%, or 100%, or in a range of from 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein.

In some embodiments, the methods for treating MMA provided herein increase the cellular enzyme activity in a subject by at least about 5%, 10%, 15%, 20%, 25%, 30%, 35%, 40%, 45%, 50%, 55%, 60%, 65%, 80%, 85%, 90%, 95%, or 100%, or in a range of from 10% to 50%, 20% to 50%, 20% to 75%, 25% to 75%, 25% to 90% or 10% to 99% relative to the respective concentration prior to administration of a polynucleotide (e.g., mRNA) encoding an MCM polypeptide, as assessed by methods well known in the art or described herein. In certain embodiment, the increase in cellular enzyme activity is determined by obtaining cells (e.g., fibroblasts or lymphocytes) from the subject, culturing the cells in the presence or absence of a polynucleotide, and comparing the cellular enzyme activity in the presence of the polynucleotide (e.g., mRNA) encoding an MCM polypeptide to the cellular enzyme activity in the absence of the polynucleotide. Techniques for measuring cellular enzyme activity are known in the art and described herein (see, e.g., Section 6, infra).

In some aspects, the methods for treating MMA provided herein improve or developmental or cognitive function in a subject. In some aspects, the methods for treating MMA provided herein improve control of muscle contractions by a subject as assessed by methods well known in the art. In some embodiments, the methods for treating MMA provided herein improve renal function In some embodiments, the methods for treating MMA provided herein decrease the need for kidney transplant, liver transplant or both. In some embodiments, the methods for treating MMA provided herein decrease the requirement for hospitalization. In some embodiments, the methods for treating MMA provided herein decrease the length and/or frequency of hospitalization.

In some embodiments, the subject is a male human. In some embodiments, the subject is a female human. In some embodiments, a subject treated for MMA in accordance with the methods provided herein is a fetus. In accordance with this embodiment, a pregnant female may be administered a polynucleotide in a manner that permits the polynucleotide to pass through the placenta to the fetus. Alternatively, the polynucleotide may be administered directly to the fetus by, e.g., injection. In some embodiments, a subject treated for MMA in accordance with the methods provided herein is a human infant. In one embodiment, a subject treated for MMA in accordance with the methods provided herein is an elderly human. In another embodiment, a subject treated for MMA in accordance with the methods provided herein is a human adult. In another embodiment, a subject treated for MMA in accordance with the methods provided herein is a human child. In another embodiment, a subject treated for MMA in accordance with the methods provided herein is a human toddler.

In a specific embodiment, a subject treated for MMA in accordance with the methods provided herein is a human that is less than 5 years old. In another specific embodiment, a subject treated for MMA in accordance with the methods provided herein is a human that is older than 5 years old. In a specific embodiment, a subject treated for MMA in accordance with the methods provided herein is a human that is less than 5 years old, is older than 5 years old, is 18 years old or is older than 18 years old.

In some embodiments, a subject treated for MMA in accordance with the methods provided herein is administered a polynucleotide (e.g., mRNA) encoding an MCM polypeptide or a pharmaceutical composition thereof, or a combination therapy before any adverse effects or intolerance to therapies other than the polynucleotide develops. In some embodiments, a subject treated for MMA in accordance with the methods provided herein is a refractory patient. In a certain embodiment, a refractory patient is an MMA patient that is refractory to a standard therapy (e.g., carnitine or cobalamin supplements).

In some embodiments, a subject treated for MMA in accordance with the methods provided herein is a human that has proven refractory to therapies other than treatment with a polynucleotide, but is no longer on these therapies. In some embodiments, a subject treated for MMA in accordance with the methods provided herein is a human already receiving one or more conventional MMA therapies, such as carnitine supplements, cobalamin supplements, antibiotics, kidney transplant, and/or liver transplant. In some embodiments, a subject treated for MMA in accordance with the methods provided herein is a human on a low-protein diet. In some embodiments, a subject treated for MMA in accordance with the methods provided herein is a human on a diet that avoids substances containing isoleucine, threonine, methionine, and valine.

In some embodiments, a subject treated for MMA in accordance with the methods provided herein is a human susceptible to adverse reactions to conventional therapies. In some embodiments, a subject treated for MMA in accordance with the methods provided herein is a human that has not received a therapy, e.g., a carnitine supplement, a cobalamin supplement, an antibiotic, a kidney transplant, and/or a liver transplant, prior to the administration of a polynucleotide or a pharmaceutical composition thereof. In some embodiments, a subject treated for MMA in accordance with the methods provided herein is a human that has received a therapy prior to administration of a polynucleotide or a pharmaceutical composition thereof. In some embodiments, a subject treated for MMA in accordance with the methods provided herein is a human that has experienced adverse side effects to the prior therapy or the prior therapy was discontinued due to unacceptable levels of toxicity to the human.

In some embodiments, a subject treated for MMA in accordance with the methods provided herein is a human diagnosed with a complete ($mut^0$) or partial ($mut^-$) defect in methylmalonyl-CoA mutase (MCM). The gene encoding MCM is referred to as the MUT gene and is located on chromosome 6p21.1.

Dosage and Administration

In accordance with the methods for treating MMA provided herein, a polynucleotide (e.g., mRNA) encoding an MCM polypeptide or a pharmaceutical composition thereof can be administered to a subject in need thereof by a variety of routes in amounts which result in a beneficial or therapeutic effect. A polynucleotide (e.g., mRNA) encoding an MCM polypeptide or pharmaceutical composition thereof may be intravenously administered to a subject in need thereof in accordance with the methods for treating MMA provided herein.

In accordance with the methods for treating MMA provided herein that involve administration of a polynucleotide (e.g., mRNA) encoding an MCM polypeptide in combination with one or more additional therapies, the polynucleotide (e.g., mRNA) encoding an MCM polypeptide and one or more additional therapies may be administered by the same route or a different route of administration.

The dosage and frequency of administration of a polynucleotide (e.g., mRNA) encoding an MCM polypeptide or a pharmaceutical composition thereof is administered to a subject in need thereof in accordance with the methods for treating MMA provided herein will be efficacious while minimizing any side effects. The exact dosage and frequency of administration of a polynucleotide (e.g., mRNA) encoding an MCM polypeptide or a pharmaceutical composition thereof can be determined by a practitioner, in light of factors related to the subject that requires treatment. Factors which may be taken into account include the severity of the disease state, general health of the subject, age, weight, and gender of the subject, diet, time and frequency of administration, drug combination(s), reaction sensitivities, and tolerance/response to therapy. The dosage and frequency of administration of a polynucleotide (e.g., mRNA) encoding an MCM polypeptide or a pharmaceutical composition thereof may be adjusted over time to provide sufficient levels of the polynucleotide or to maintain the desired effect.

In some embodiments, a polynucleotide (e.g., mRNA) encoding an MCM polypeptide or a pharmaceutical composition thereof is administered to a subject in need thereof in accordance with the methods for treating MMA provided herein at a dosage and a frequency of administration that achieves one or more of the following: (i) the reduction or amelioration of the severity of one or more MMA symptoms; (ii) the reduction in the duration of one or more symptoms associated with MMA; (iii) the prevention in the recurrence of a symptom associated with MMA; (iv) the reduction in hospitalization of a subject; (v) a reduction in hospitalization length; (vi) the increase in the survival of a subject; (vii) the enhancement or improvement of the therapeutic effect of another therapy; (viii) an improvement in developmental or cognitive ability; (ix) a decrease in the frequency and/or number of metabolic decompensation episodes; (x) an improvement in control of muscle contraction; (xi) a reduction in mortality; (xii) an increase in the survival rate of patients; (xiii) a decrease in hospitalization rate; (xiv) the prevention of the development or onset of one or more symptoms associated with MMA; (xv) the reduction in the number of symptoms associated with MMA; (xvi) an decrease in the concentration of methylmalonic acid in biological fluids (e.g., plasma or urine); (xvii) a decrease in the concentration of metabolites of methylmalonic acid, such as propionylcarnitine or methylcitrate, in biological fluids (e.g., plasma or urine); (xviii) a decrease in erythrocyte odd-numbered long-chain fatty acid levels; (xix) an increase in the urinary urea:methylmalonic acid ratio; (xx) an increase in symptom-free survival of MMA patients; (xxi) an improvement in renal function; and (xxii) improvement in quality of life as assessed by methods well known in the art.

In some embodiments, a polynucleotide (e.g., mRNA) encoding an MCM polypeptide or a pharmaceutical composition thereof is administered to a subject in need thereof in accordance with the methods for treating MMA provided herein once in a day. In some embodiments, a polynucleotide (e.g., mRNA) encoding an MCM polypeptide or a pharmaceutical composition thereof is administered to a subject in need thereof in accordance with the methods for treating MMA provided herein once every two days. In some embodiments, a polynucleotide (e.g., mRNA) encoding an MCM polypeptide or a pharmaceutical composition thereof is administered to a subject in need thereof in accordance with the methods for treating MMA provided herein once every three days. In some embodiments, a polynucleotide (e.g., mRNA) encoding an MCM polypeptide or a pharmaceutical composition thereof is administered to a subject in need thereof in accordance with the methods for treating MMA provided herein once every four days. In some embodiments, a polynucleotide (e.g., mRNA) encoding an MCM polypeptide or a pharmaceutical composition thereof is administered to a subject in need thereof in accordance with the methods for treating MMA provided herein once every five days. In some embodiments, a polynucleotide (e.g., mRNA) encoding an MCM polypeptide or a pharmaceutical composition thereof is administered to a subject in need thereof in accordance with the methods for treating MMA provided herein once every six days. In some embodiments, a polynucleotide (e.g., mRNA) encoding an MCM polypeptide or a pharmaceutical composition thereof is administered to a subject in need thereof in accordance with the methods for treating MMA provided herein once every week. In some embodiments, a polynucleotide (e.g., mRNA) encoding an MCM polypeptide or a pharmaceutical composition thereof is administered to a subject in need thereof in accordance with the methods for treating MMA provided herein once every two weeks. In some embodiments, a polynucleotide (e.g., mRNA) encoding an MCM polypeptide or a pharmaceutical composition thereof is administered to a subject in need thereof in accordance with the methods for treating MMA provided herein once every three weeks. In some embodiments, a polynucleotide (e.g., mRNA) encoding an MCM polypeptide or a pharmaceutical composition thereof is administered to a subject in need thereof in accordance with the methods for treating MMA provided herein once every month. In some embodiments, a polynucleotide (e.g., mRNA) encoding an MCM polypeptide or a pharmaceutical composition thereof is administered to a subject in need thereof in accordance with the methods for treating MMA provided herein on a monthly schedule sufficient to maintain decreased symptoms in a MMA patient suffering therefrom. In some embodiments, provide herein are methods for continuous therapy wherein a polynucleotide (e.g., mRNA) encoding an MCM polypeptide or a pharmaceutical composition thereof is administered to a subject in need thereof in accordance with the methods for treating MMA provided herein daily for a certain period of time. In some embodiments, a polynucleotide (e.g., mRNA) encoding an MCM polypeptide or a pharmaceutical composition thereof is administered continuously in subsequent 24 hour periods daily, weekly, monthly or yearly.

Treatment periods for a course of therapy can span one week, two weeks, three weeks, four weeks, five weeks, six weeks, seven weeks, eight weeks, nine weeks, ten weeks, eleven weeks, twelve weeks, thirteen weeks, fourteen weeks, four months, five months, six months, seven months, eight months, nine months, ten months, eleven months, one year, two years, three years, four years, five years or longer. The treatment periods can be interrupted by periods of rest which can span a day, one week, two weeks, three weeks, four weeks, five weeks, six weeks, seven weeks, eight weeks, nine weeks, ten weeks, eleven weeks, twelve weeks, thirteen weeks, fourteen weeks, four months, five months, six months, seven months, eight months, nine months, ten months, eleven months, one year, two years, three years, four years, five years or longer. Such determinations can be made by one skilled in the art (e.g., a physician). In some embodiments, treatment is intermittent, with periods of treatment being followed by periods of no treatment. Continuous treatment can be interrupted by one or more days, months, weeks or years. Continuous treatment can also be followed by a rest period lasting one or more days, months, weeks or years, with continuous treatment then resuming after the rest period.

In a particular embodiment, a polynucleotide or a pharmaceutical composition thereof is administered in a dose of about 0.01-10 mg/kg. In a particular embodiment, a polynucleotide or a pharmaceutical composition thereof is administered in a dose of about 0.01 mg/kg, 0.02 mg/kg, 0.03 mg/kg, 0.04 mg/kg, 0.05 mg/kg, 0.06 mg/kg, 0.07 mg/kg, 0.08, mg/kg, 0.09 mg/kg, 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, 0.9 mg/kg, 1.0 mg/kg, 1.1 mg/kg, 1.2 mg/kg, 1.3 mg/kg, about 1.4 mg/kg, 1.5 mg/kg, 1.6 mg/kg, about 1.7 mg/kg, 1.8 mg/kg, 1.9 mg/kg, about 2.0 mg/kg, 2.1 mg/kg, 2.2 mg/kg, about 2.3 mg/kg, 2.4 mg/kg, 2.5 mg/kg, 3.0 mg/kg, 3.5 mg/kg, 4.0 mg/kg or about 5.0 mg/kg. In a particular embodiment, a polynucleotide or a pharmaceutical composition thereof is administered in a dose of about 0.01-2 mg/kg. In a particular embodiment, a polynucleotide or a pharmaceutical composition thereof is administered in a dose of about 0.02-1 mg/kg. In a particular embodiment, a polynucleotide or a pharmaceutical composition thereof is administered in a dose of about 0.02-1 mg/kg. In a particular embodiment, a polynucleotide or a pharmaceutical composition thereof is administered in a dose of about 0.02-0.5 mg/kg. In a particular embodiment, a polynucleotide or a pharmaceutical composition thereof is administered in a dose of about 0.03-0.5 mg/kg. In a particular embodiment, a polynucleotide or a pharmaceutical composition thereof is administered in a dose of about 0.04-0.5 mg/kg. In a particular embodiment, a polynucleotide or a pharmaceutical composition thereof is administered in a dose of about 0.05-0.5 mg/kg.

In a particular embodiment, a polynucleotide or a pharmaceutical composition thereof is administered in a dose of about 0.02-0.5 mg/kg. In a particular embodiment, a polynucleotide or a pharmaceutical composition thereof is administered in a dose of about 0.02-0.1 or 0.2 mg/kg. In a particular embodiment, a polynucleotide or a pharmaceutical composition thereof is administered in a dose of about 0.02-0.1 or 0.2 mg/kg. In a particular embodiment, a polynucleotide or a pharmaceutical composition thereof is administered in a dose of about 0.03-0.1 or 0.2 mg/kg. In a particular embodiment, a polynucleotide or a pharmaceutical composition thereof is administered in a dose of about 0.04-0.1 or 0.2 mg/kg. In a particular embodiment, a polynucleotide or a pharmaceutical composition thereof is administered in a dose of about 0.05-0.1 or 0.2 mg/kg.

In other embodiments, an effective dose for the polynucleotide of the disclosure is 0.1 mg/kg to 1.0 mg/kg, 0.1 mg/kg to 10 mg/kg, 0.1 mg/kg to 2 mg/kg, 0.1 mg/kg to 5 mg/kg, 1 mg/kg to 5 mg/kg, or 1 mg/kg to 3 mg/kg. In some embodiments, the effective dose is sufficient to reduce the plasma MMA level after the administration at least 70%, at least 75%, at least 80%, at least 85%, at least 90%, or at least 95% compared to the plasma MMA level prior to the administration. In other embodiments, the plasma MMA level is reduced about 75% to 85% compared to the plasma MMA level prior to the administration.

In other embodiments, the effective dose is sufficient to maintain the plasma MMA level after the administration lower than about 5 µmol/L, about 4.5 µmol/L, about 4 µmol/L, about 3.5 µmol/L, about 3 µmol/L, about 2.5 µmol/L, about 2 µmol/L, about 1.5 µmol/L, about 1 µmol/L, about 0.9 µmol/L, about 0.8 µmol/L, about 0.7 µmol/L, about 0.6 µmol/L, about 0.5 µmol/L, about 0.4 µmol/L, about 0.3 µmol/L, or 0.27 µmol/L.

In certain embodiments, the effective dose is sufficient to maintain the urinary MMA level less than 2000 mmol/mol creatinine, less than 1900 mmol/mol creatinine, less than 1800 mmol/mol creatinine, less than 1700 mmol/mol creatinine, less than 1600 mmol/mol creatinine, less than 1500 mmol/mol creatinine, less than 1400 mmol/mol creatinine, less than 1300 mmol/mol creatinine, less than 1200 mmol/mol creatinine, less than 1100 mmol/mol creatinine, less than 1000 mmol/mol creatinine, 900 mmol/mol creatinine, 800 mmol/mol creatinine, 700 mmol/mol creatinine, 600 mmol/mol creatinine, 500 mmol/mol creatinine, 400 mmol/mol creatinine, 300 mmol/mol creatinine, 200 mmol/mol creatinine, 100 mmol/mol creatinine, 90 mmol/mol creatinine, 80 mmol/mol creatinine, 70 mmol/mol creatinine, 60 mmol/mol creatinine, 50 mmol/mol creatinine, 40 mmol/mol creatinine, 30 mmol/mol creatinine, 20 mmol/mol creatinine, 10 mmol/mol creatinine, 9 mmol/mol creatinine, 8 mmol/mol creatinine, 7 mmol/mol creatinine, 6 mmol/mol creatinine, 5 mmol/mol creatinine, 4 mmol/mol creatinine, 3 mmol/mol creatinine, 2 mmol/mol creatinine, or 1 mmol/mol creatinine.

In some embodiments, a method for treating MMA presented herein involves the administration to a subject in need thereof of one or more doses of an effective amount of a polynucleotide (e.g., mRNA) encoding an MCM polypeptide or a pharmaceutical composition, wherein the effective amount may or may not be the same for each dose. In some embodiments, a first dose of a polynucleotide or pharmaceutical composition thereof is administered to a subject in need thereof for a first period of time, and subsequently, a second dose of a polynucleotide is administered to the subject for a second period of time. The first dose may be more than the second dose, or the first dose may be less than the second dose. A third dose of a polynucleotide also may be administered to a subject in need thereof for a third period of time.

The length of time that a subject in need thereof is administered a polynucleotide or a pharmaceutical composition thereof in accordance with the methods for treating MMA presented herein will be the time period that is determined to be efficacious. In some embodiments, a method for treating MMA presented herein involves the administration of a polynucleotide or a pharmaceutical composition thereof for a period of time until the severity and/or number of symptoms associated with MMA decrease.

It will be understood that the amounts of a polynucleotide or a pharmaceutical composition thereof administered to a patient in need thereof are or can be calculated based upon the actual weight of the patient in question or the average weight of the patient population in question.

Combination Therapy

Presented herein are combination therapies for the treatment of MMA which involve the administration of a polynucleotide (e.g., mRNA) encoding an MCM polypeptide in combination with one or more additional therapies to a subject in need thereof. In a specific embodiment, presented herein are combination therapies for the treatment of MMA which involve the administration of an effective amount of a polynucleotide (e.g., mRNA) encoding an MCM polypeptide in combination with an effective amount of another therapy to a subject in need thereof. Specific examples of such other therapies include, but are not limited to, carnitine supplements (such as L-carnitine), cobalamin supplements and antibiotics (such as metronidazole).

The combination therapies provided herein involve administrating to a subject to in need thereof a polynucleotide or a pharmaceutical composition thereof in combination with conventional, or known, therapies for MMA. Current therapies for MMA, include carnitine supplements, cobalamin supplements and antibiotics. Other therapies for MMA or a condition associated therewith are aimed at controlling or relieving symptoms, e.g., anti-seizure medication. Accordingly, in some embodiments, the combination therapies provided herein involve administrating to a subject to in need thereof a pain reliever, a medication for epileptic seizures, or other therapy aimed at alleviating or controlling symptoms associated with MMA or a condition associated therewith.

In some embodiments, the methods for treating MMA provided herein comprise administering a polynucleotide (e.g., mRNA) encoding an MCM polypeptide as a single agent for a period of time prior to administering the polynucleotide in combination with an additional therapy. In some embodiments, the methods for treating MMA provided herein comprise administering an additional therapy alone for a period of time prior to administering a polynucleotide (e.g., mRNA) encoding an MCM polypeptide in combination with the additional therapy.

In some embodiments, the administration of a polynucleotide (e.g., mRNA) encoding an MCM polypeptide and one or more additional therapies in accordance with the methods presented herein have an additive effect relative the administration of the polynucleotide or said one or more additional therapies alone. In some embodiments, the administration of a polynucleotide (e.g., mRNA) encoding an MCM polypeptide and one or more additional therapies in accordance with the methods presented herein have a synergistic effect relative to the administration of the polynucleotide or said one or more additional therapies alone.

The combination of a polynucleotide (e.g., mRNA) encoding an MCM polypeptide and one or more additional therapies can be administered to a subject in the same pharmaceutical composition. Alternatively, a polynucleotide (e.g., mRNA) encoding an MCM polypeptide and one or more additional therapies can be administered concurrently to a subject in separate pharmaceutical compositions. A polynucleotide (e.g., mRNA) encoding an MCM polypeptide and one or more additional therapies can be administered sequentially to a subject in separate pharmaceutical compositions. A polynucleotide (e.g., mRNA) encoding an MCM polypeptide and one or more additional therapies may also be administered to a subject by the same or different routes of administration.

In some embodiments, the combination therapies provided herein involve administering to a subject in need thereof a polynucleotide (e.g., mRNA) encoding an MCM polypeptide or a pharmaceutical composition thereof in combination with one or more of the following: a carnitine supplement (e.g., L-carnitine), a cobalamin supplement and an antibiotic. In some embodiments, the combination therapies provided herein involve administering to a subject in need thereof a polynucleotide (e.g., mRNA) encoding an MCM polypeptide or a pharmaceutical composition thereof in combination with an organ transplant (e.g., a kidney, liver or kidney and liver transplant).

Clinical Objectives

Efficacy of a polynucleotide for treating MMA may be assessed by determining the effects of the polynucleotide on reduction of plasma methylmalonic acid. The efficacy of a polynucleotide for treating MMA may also be assessed by: (i) determining the effect on urinary levels of methylcitrate; (ii) determining the effect on plasma levels of propionlycarnitine; (iii) evaluating effects on erythrocyte odd long-chain fatty acid levels; (iv) determining effects on the urinary urea:methylmalonic acid ratio; (v) determining the effects on enzyme activity in cultured fibroblasts and lymphocytes from subjects with MMA, (vi) evaluating the effects on the developmental and cognitive ability of subjects; (vii) evaluating the effects on the dystonia rating scale; (viii) evaluating the effects on the occurrence of any metabolic decompensation episodes; (ix) evaluating the safety profile of the polynucleotide; (x) evaluating compliance with treatment with the polynucleotide; and (xi) determining the polynucleotide's plasma exposure over time.

Clinical Endpoints

A primary clinical endpoint for efficacy of a polynucleotide for treating MMA includes a reduction in plasma methylmalonic acid levels. Other clinical endpoints for the efficacy of a polynucleotide for treating MMA may include: a reduction in urinary methylmalonic acid levels;

a reduction in urinary methylcitrate; a reduction in plasma propionylcarnitine; a reduction in erythrocyte odd long-chain fatty acid levels; an increase in the urea:methylmalonic acid ratio;

and pharmacokinetic parameters, e.g., time to maximum plasma concentration ($T_{max}$), $C_{max}$, AUC, terminal elimination half-life ($t_{1/2}$) based on a polynucleotide's plasma concentrations as assessed by a validated bioanalytical method.

Plasma Methylmalonic Acid Levels

Plasma methylmalonic acid levels may be used to indicate the effectiveness of a polynucleotide to increase the activity of the relevant enzyme or factor (e.g., MCM). Normal plasma methylmalonic acid level is about <0.27 µmol/L (Fowler et al., 2008, J. Inherit. Metab. Dis. 31: 350-360). Plasma methylmalonic acid levels are elevated in patients with MMA, generally in the range of about 100 to about 1.000 µmol/L in cobalamin-non responsive patients and about 5 to about 100 µmol/L in cobalamin-responsive patients (Venditti, 2007, Gene Reviews). Methylmalonic acid is considered to be nephrotoxic, and central nervous system trapping of methylmalonic acid, propionyl-CoA, and 2 methylcitrate is considered to be the basis for chronic neurologic complications of MMA (Morath et al., 2008, J. Inherit. Metab. Dis. 31: 35-43). A decrease by >30% in plasma or urine methylmalonic acid levels has been considered by some to be a clinically relevant difference (Zwickler et al., 2008, J. Inherit. Metab. Dis. 31: 361-367).

Blood may be collected and plasma methylmalonic acid concentrations may be determined using a standard gas chromatography/mass spectroscopy (GC/MS) stable-isotope dilution method.

Urinary Methylmalonic Acid Levels

Urinary methylmalonic acid levels may be used to indicate the effectiveness of a polynucleotide to increase the activity of the relevant enzyme or factor (e.g., MCM). The normal urinary methylmalonic acid level is <4 mmol/mol creatinine (Venditti, 2007, Gene Reviews), and the level is significantly elevated in MMA. In general, the more severe types of MMA, mut[0] and cblB, have higher urinary methylmalonic acid levels (about 5,000 to >10.000 mmol/mol creatinine) compared to the less severe types, mut[−] and cblA (<1,000 to >5,000 mol/mol creatinine) (Horster et al., 2007, Pediatr. Res. 62: 225-230; Fowler et al., 2008, J. Inherit. Metab. Dis. 31: 350-360). It has been observed that chronic renal failure does not occur in patients with urinary methylmalonic acid levels below—2.000 mmol/mol creatinine (Horster et al., 2007, Pediatr. Res. 62: 225-230).

Urine may be collected and urinary methylmalonic acid concentrations may be determined using a standard gas chromatography/mass spectroscopy (GC/MS) stable-isotope dilution method.

Plasma Propionylcarnitine, Urinary Methylcitrate, Erythrocyte OLCFAs, Urinary Urea:Methylmalonic Acid Ratio Plasma propionylcarnitine and urinary methylcitrate are methylmalonic acid metabolites and may be used to indicate the effectiveness of a polynucleotide (e.g., mRNA) encoding an MCM polypeptide to increase the activity of the relevant enzyme or factor (e.g., MCM). It has been suggested that plasma propionylcarnitine may be a more useful measurement than urinary methylmalonic acid in the presence of renal insufficiency (Horster et al., 2007, Pediatr. Res. 62: 225-230). Urinary methylcitrate has been found to be elevated in the setting of elevated methylmalonic acid levels (Fowler et al., 2008, J. Inherit. Metab. Dis. 31: 350-360). Blood and urine may be collected and standard techniques may be used to determine plasma propionylcarnitine levels and urinary methylcitrate levels, respectively.

OLCFAs are measured in erythrocyte membrane lipids and may be used to indicate the effectiveness of a polynucleotide (e.g., mRNA) encoding an MCM polypeptide to increase the activity of the relevant enzyme or factor (e.g., MCM). Erythrocyte OLCFAs values reflect both the severity of the disease and the quality of the dietary control in MMA (Merinero et al., 2008, J. Inherit. Metab. Dis. 31: 55-66). This parameter is indicative of the propionyl-CoA load of the cells and of long-term metabolic control in organic acidemias (Merinero et al., 2008, J. Inherit. Metab. Dis. 31: 55-66; Sperl et al., 2000, Eur. J. Pediatr. 159: 54-88). A standard method for determination of erythrocyte OLCFAs concentrations is available.

An increase in urinary urea:methylmalonic acid ratio following administration of a polynucleotide (e.g., mRNA) encoding an MCM polypeptide compared to baseline may indicate an increase in activity of the deficient enzyme or factor (MCM, cblA, or cblB). Protein catabolism leads to production of both urea and methylmalonic acid. The values of these catabolic products may fluctuate with dietary protein intake. If the source of methylmalonic acid is predominantly natural protein, in patients with no enzyme activity (e.g., mut$^0$ patients) the ratio of urinary urea:methylmalonic acid is approximately 3.5. If there is residual enzyme activity (e.g., administration of vitamin B12 to cobalamin-sensitive patients) the ratio is generally >5. Patients receiving amino acid supplements will produce more urea than methylmalonic acid and will have a urea:MMA ratio>5. However, even in this category of patients the urea:MMA ratio will increase if the activity of the deficient enzyme or factor increases, (Valayannopoulos et al., Annual Symposium of the Society for the Study of Inborn Errors of Metabolism, Amsterdam, The Netherlands, September 2004).

VIII. Kits and Devices

Kits

The disclosure provides a variety of kits for conveniently and/or effectively using the claimed nucleotides of the present disclosure. Typically kits will comprise sufficient amounts and/or numbers of components to allow a user to perform multiple treatments of a subject(s) and/or to perform multiple experiments.

In one aspect, the present disclosure provides kits comprising the molecules (polynucleotides) of the disclosure.

Said kits can be for protein production, comprising a first polynucleotides comprising a translatable region. The kit can further comprise packaging and instructions and/or a delivery agent to form a formulation composition. The delivery agent can comprise a saline, a buffered solution, a lipidoid or any delivery agent disclosed herein.

In some embodiments, the buffer solution can include sodium chloride, calcium chloride, phosphate and/or EDTA. In another embodiment, the buffer solution can include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See, e.g., U.S. Pub. No. 20120258046; herein incorporated by reference in its entirety). In a further embodiment, the buffer solutions can be precipitated or it can be lyophilized. The amount of each component can be varied to enable consistent, reproducible higher concentration saline or simple buffer formulations. The components can also be varied in order to increase the stability of modified RNA in the buffer solution over a period of time and/or under a variety of conditions. In one aspect, the present disclosure provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present disclosure provides kits for protein production, comprising a polynucleotide comprising a translatable region, wherein the polynucleotide exhibits reduced degradation by a cellular nuclease, and packaging and instructions.

In one aspect, the present disclosure provides kits for protein production, comprising a polynucleotide comprising a translatable region, wherein the polynucleotide exhibits reduced degradation by a cellular nuclease, and a mammalian cell suitable for translation of the translatable region of the first nucleic acid.

Devices

The present disclosure provides for devices that can incorporate polynucleotides that encode polypeptides of interest. These devices contain in a stable formulation the reagents to synthesize a polynucleotide in a formulation available to be immediately delivered to a subject in need thereof, such as a human patient Devices for administration can be employed to deliver the polynucleotides of the present disclosure according to single, multi- or split-dosing regimens taught herein. Such devices are taught in, for example, International Application PCT/US2013/30062 filed Mar. 9, 2013, the contents of which are incorporated herein by reference in their entirety.

Method and devices known in the art for multi-administration to cells, organs and tissues are contemplated for use in conjunction with the methods and compositions disclosed herein as embodiments of the present disclosure. These include, for example, those methods and devices having multiple needles, hybrid devices employing for example lumens or catheters as well as devices utilizing heat, electric current or radiation driven mechanisms.

According to the present disclosure, these multi-administration devices can be utilized to deliver the single, multi- or split doses contemplated herein. Such devices are taught for example in, International Application PCT/US2013/30062 filed Mar. 9, 2013, the contents of which are incorporated herein by reference in their entirety.

In some embodiments, the polynucleotide is administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period).

Methods and Devices Utilizing Catheters and/or Lumens

Methods and devices using catheters and lumens can be employed to administer the polynucleotides of the present disclosure on a single, multi- or split dosing schedule. Such methods and devices are described in International Application PCT/US2013/30062 filed Mar. 9, 2013, the contents of which are incorporated herein by reference in their entirety.

Methods and Devices Utilizing Electrical Current

Methods and devices utilizing electric current can be employed to deliver the polynucleotides of the present disclosure according to the single, multi- or split dosing regimens taught herein. Such methods and devices are described in International Application PCT/US2013/30062 filed Mar. 9, 2013, the contents of which are incorporated herein by reference in their entirety.

IX. Definitions

In order that the present disclosure can be more readily understood, certain terms are first defined. As used in this application, except as otherwise expressly provided herein, each of the following terms shall have the meaning set forth below. Additional definitions are set forth throughout the application.

The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

In this specification and the appended claims, the singular forms "a," "an" and "the" include plural referents unless the context clearly dictates otherwise. The terms "a" (or "an"), as well as the terms "one or more," and "at least one" can be used interchangeably herein. In certain aspects, the term "a" or "an" means "single." In other aspects, the term "a" or "an" includes "two or more" or "multiple."

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Wherever aspects are described herein with the language "comprising," otherwise analogous aspects described in terms of "consisting of" and/or "consisting essentially of" are also provided.

Units, prefixes, and symbols are denoted in their Système International de Unites (SI) accepted form. Numeric ranges are inclusive of the numbers defining the range. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the disclosure. Where a value is explicitly recited, it is to be understood that values that are about the same quantity or amount as the recited value are also within the scope of the disclosure. Where a combination is disclosed, each subcombination of the elements of that combination is also specifically disclosed and is within the scope of the disclosure. Conversely, where different elements or groups of elements are individually disclosed, combinations thereof are also disclosed. Where any element of an disclosure is disclosed as having a plurality of alternatives, examples of that disclosure in which each alternative is excluded singly or in any combination with the other alternatives are also hereby disclosed; more than one element of an disclosure can have such exclusions, and all combinations of elements having such exclusions are hereby disclosed.

Nucleotides are referred to by their commonly accepted single-letter codes. Unless otherwise indicated, nucleic acids are written left to right in 5' to 3' orientation. Nucleotides are referred to herein by their commonly known one-letter symbols recommended by the IUPAC-IUB Biochemical Nomenclature Commission. Accordingly, A represents adenine, C represents cytosine, G represents guanine, T represents thymine, U represents uracil.

Amino acids are referred to herein by either their commonly known three letter symbols or by the one-letter symbols recommended by the IUPAC-IUB Biochemical Nomenclature Commission. Unless otherwise indicated, amino acid sequences are written left to right in amino to carboxy orientation.

At various places in the present specification, substituents of compounds of the present disclosure are disclosed in groups or in ranges. It is specifically intended that the present disclosure include each and every individual subcombination of the members of such groups and ranges About: As used herein, the term "about" means+/−10% of the recited value.

Administered in combination: As used herein, the term "administered in combination" or "combined administration" means that two or more agents are administered to a subject at the same time or within an interval such that there can be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Amino acid substitution: The term "amino acid substitution" refers to replacing an amino acid residue present in a parent sequence (e.g., a consensus sequence) with another amino acid residue. An amino acid can be substituted in a parent sequence, for example, via chemical peptide synthesis or through recombinant methods known in the art. Accordingly, a reference to a "substitution at position X" refers to the substitution of an amino acid present at position X with an alternative amino acid residue. In some aspects, substitution patterns can be described according to the schema AnY, wherein A is the single letter code corresponding to the amino acid naturally present at position n, and Y is the substituting amino acid residue. In other aspects, substitution patterns can be described according to the schema An(YZ), wherein A is the single letter code corresponding to the amino acid residue substituting the amino acid naturally present at position X, and Y and Z are alternative substituting amino acid residue, i.e., In the context of the present disclosure, substitutions (even when they referred to as amino acid substitution) are conducted at the nucleic acid level, i.e., substituting an amino acid residue with an alternative amino acid residue is conducted by substituting the codon encoding the first amino acid with a codon encoding the second amino acid.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately," as applied to one or more values of interest, refers to a value that is similar to a stated reference value. In certain embodiments, the term "approximately" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein with respect to a disease, the term "associated with" means that the symptom, measurement, characteristic, or status in question is linked to the diagnosis, development, presence, or progression of that disease. As association may, but need not, be causatively linked to the disease.

When used with respect to two or more moieties, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It can also suggest ionic or hydrogen bonding or a hybridization based connectivity sufficiently stable such that the "associated" entities remain physically associated.

Bifunctional: As used herein, the term "bifunctional" refers to any substance, molecule or moiety that is capable of or maintains at least two functions. The functions can affect the same outcome or a different outcome. The structure that produces the function can be the same or different. For example, bifunctional modified RNAs of the present disclosure can encode a cytotoxic peptide (a first function) while those nucleosides that comprise the encoding RNA are, in and of themselves, cytotoxic (second function). In this example, delivery of the bifunctional modified RNA to a cancer cell would produce not only a peptide or protein molecule that can ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present disclosure can be considered biologically active if even a portion of the polynucleotide is biologically active or mimics an activity considered biologically relevant.

Chimera: As used herein, "chimera" is an entity having two or more incongruous or heterogeneous parts or regions.

Conservative amino acid substitution: A "conservative amino acid substitution" is one in which the amino acid residue is replaced with an amino acid residue having a similar side chain. Families of amino acid residues having similar side chains have been defined in the art, including basic side chains (e.g., lysine, arginine, or histidine), acidic side chains (e.g., aspartic acid or glutamic acid), uncharged polar side chains (e.g., glycine, asparagine, glutamine, serine, threonine, tyrosine, or cysteine), nonpolar side chains (e.g., alanine, valine, leucine, isoleucine, proline, phenylalanine, methionine, or tryptophan), beta-branched side chains (e.g., threonine, valine, isoleucine) and aromatic side chains (e.g., tyrosine, phenylalanine, tryptophan, or histidine). Thus, if an amino acid in a polypeptide is replaced with another amino acid from the same side chain family, the amino acid substitution is considered to be conservative. In another aspect, a string of amino acids can be conservatively replaced with a structurally similar string that differs in order and/or composition of side chain family members.

Non-conservative amino acid substitutions include those in which (i) a residue having an electropositive side chain (e.g., Arg, His or Lys) is substituted for, or by, an electronegative residue (e.g., Glu or Asp), (ii) a hydrophilic residue (e.g., Ser or Thr) is substituted for, or by, a hydrophobic residue (e.g., Ala, Leu, Ile, Phe or Val), (iii) a cysteine or proline is substituted for, or by, any other residue, or (iv) a residue having a bulky hydrophobic or aromatic side chain (e.g., Val, His, Ile or Trp) is substituted for, or by, one having a smaller side chain (e.g., Ala or Ser) or no side chain (e.g., Gly).

Other amino acid substitutions can be readily identified by workers of ordinary skill. For example, for the amino acid alanine, a substitution can be taken from any one of D-alanine, glycine, beta-alanine, L-cysteine and D-cysteine. For lysine, a replacement can be any one of D-lysine, arginine, D-arginine, homo-arginine, methionine, D-methionine, ornithine, or D-ornithine. Generally, substitutions in functionally important regions that can be expected to induce changes in the properties of isolated polypeptides are those in which (i) a polar residue, e.g., serine or threonine, is substituted for (or by) a hydrophobic residue, e.g., leucine, isoleucine, phenylalanine, or alanine; (ii) a cysteine residue is substituted for (or by) any other residue; (iii) a residue having an electropositive side chain, e.g., lysine, arginine or histidine, is substituted for (or by) a residue having an electronegative side chain, e.g., glutamic acid or aspartic acid; or (iv) a residue having a bulky side chain, e.g., phenylalanine, is substituted for (or by) one not having such a side chain, e.g., glycine. The likelihood that one of the foregoing non-conservative substitutions can alter functional properties of the protein is also correlated to the position of the substitution with respect to functionally important regions of the protein: some non-conservative substitutions can accordingly have little or no effect on biological properties.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence can apply to the entire length of an polynucleotide or polypeptide or can apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present disclosure can be single units or multimers or comprise one or more components of a complex or higher order structure.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance that facilitates, at least in part, the in vivo delivery of a polynucleotide to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties that are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels can be located at any position in the peptides or proteins disclosed herein. They can be within the amino acids, the peptides, or proteins, or located at the N- or C-termini.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Effective Amount: As used herein, the term "effective amount" of an agent is that amount sufficient to effect beneficial or desired results, for example, clinical results, and, as such, an "effective amount" depends upon the context in which it is being applied. The term "effective amount" can be used interchangeably with "effective dose," "therapeutically effective amount," or "therapeutically effective dose."

Enantiomer: As used herein, the term "enantiomer" means each individual optically active form of a compound of the disclosure, having an optical purity or enantiomeric excess (as determined by methods standard in the art) of at least 80% (i.e., at least 90% of one enantiomer and at most 10% of the other enantiomer), at least 90%, or at least 98%.

Encapsulate: As used herein, the term "encapsulate" means to enclose, surround or encase.

Encoded protein cleavage signal: As used herein, "encoded protein cleavage signal" refers to the nucleotide sequence that encodes a protein cleavage signal.

Engineered: As used herein, embodiments of the disclosure are "engineered" when they are designed to have a feature or property, whether structural or chemical, that varies from a starting point, wild type or native molecule.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats high cholesterol, an effective amount of an agent is, for example, an amount sufficient to achieve treatment, as defined herein, of high cholesterol, as compared to the response obtained without administration of the agent.

Exosome: As used herein, "exosome" is a vesicle secreted by mammalian cells or a complex involved in RNA degradation.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least a polynucleotide and a delivery agent.

Fragment: A "fragment," as used herein, refers to a portion. For example, fragments of proteins can comprise polypeptides obtained by digesting full-length protein isolated from cultured cells.

Functional: As used herein, a "functional" biological molecule is a biological molecule in a form in which it exhibits a property and/or activity by which it is characterized.

Homology: As used herein, the term "homology" refers to the overall relatedness between polymeric molecules, e.g., between nucleic acid molecules (e.g., DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the disclosure, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the disclosure, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between polynucleotide molecules (e.g., DNA molecules and/or RNA molecules) and/or between polypeptide molecules. Percent identity can be calculated between two DNA molecules, between two RNA molecules, and between a DNA molecule and an RNA molecule. When DNA and RNA are compared, T is considered to be U (or vice versa).

Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Intact: As used herein, in the context of a polypeptide, the term "intact" means retaining an amino acid corresponding to the wild-type protein, e.g., not mutating or substituting the wild-type amino acid.

Isomer: As used herein, the term "isomer" means any tautomer, stereoisomer, enantiomer, or diastereomer of any compound of the disclosure. It is recognized that the compounds of the disclosure can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the disclosure, the chemical structures depicted herein, and therefore the compounds of the disclosure, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the disclosure can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances can have varying levels of purity in reference to the substances from which they have been associated. Isolated substances and/or entities can be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof.

A polynucleotide, vector, polypeptide, cell, or any composition disclosed herein that is "isolated" is a polynucleotide, vector, polypeptide, cell, or composition that is in a form not found in nature. Isolated polynucleotides, vectors, polypeptides, or compositions include those that have been purified to a degree that they are no longer in a form in which they are found in nature. In some aspects, a polynucleotide, vector, polypeptide, or composition that is isolated is substantially pure.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker can be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleotides) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

MCM Associated Disease: As used herein, an "MCM-associated disease" or "MCM-associated disorder" refers to diseases or disorders, respectively, which results from aberrant MCM activity (e.g., decreased activity or increased activity). As a non-limiting example, methylmalonic acidemia an MCM-associated disease.

Mitochondrial transit peptide: As used herein, the terms "mitochondrial transit peptide," "mitochondrial targeting peptide," and "mitochondrial targeting sequence" refer to an amino acid sequence (or a polynucleotide encoding such an amino acid sequence) that is a part of a larger polypeptide, where that sequence directs the transport or localization of the larger polypeptide to mitochondria.

Modified: As used herein "modified" refers to a changed state or structure of a molecule of the disclosure. Molecules can be modified in many ways including chemically, structurally, and functionally. In some embodiments, the mRNA molecules of the present disclosure are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Naturally occurring: As used herein, "naturally occurring" means existing in nature without artificial aid.

Non-human vertebrate: As used herein, a "non-human vertebrate" includes all vertebrates except Homo sapiens, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Nucleic acid sequence: The terms "nucleic acid sequence" and "nucleotide sequence" are used interchangeably and refer to a contiguous nucleic acid sequence. The sequence can be either single stranded or double stranded DNA or RNA, e.g., an mRNA.

The term "nucleic acid," in its broadest sense, includes any compound and/or substance that comprises a polymer of nucleotides. These polymers are often referred to as polynucleotides. Exemplary nucleic acids or polynucleotides of the disclosure include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

The phrase "nucleotide sequence encoding" and variants thereof refers to the nucleic acid (e.g., an mRNA or DNA molecule) coding sequence that comprises a nucleotide sequence that encodes a polypeptide or functional fragment thereof as set forth herein. The coding sequence can further include initiation and termination signals operably linked to regulatory elements including a promoter and polyadenylation signal capable of directing expression in the cells of an individual or mammal to which the nucleic acid is administered. The coding sequence can further include sequences that encode signal peptides or targeting peptides, e.g., mitochondrial transit peptides.

Off-target: As used herein, "off target" refers to any unintended effect on any one or more target, gene, or cellular transcript.

Open reading frame: As used herein, "open reading frame" or "ORF" refers to a sequence that does not contain a stop codon in a given reading frame.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g., alkyl) per se is optional.

Part: As used herein, a "part" or "region" of a polynucleotide is defined as any portion of the polynucleotide that is less than the entire length of the polynucleotide.

Peptide: As used herein, "peptide" is less than or equal to 50 amino acids long, e.g., about 5, 10, 15, 20, 25, 30, 35, 40, 45, or 50 amino acids long.

Patient: As used herein, "patient" refers to a subject who can seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms that are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients can include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound that contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are used. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the disclosure wherein molecules of a suitable solvent are incorporated in the crystal lattice. A suitable solvent is physiologically tolerable at the dosage administered. For example, solvates can be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites;

and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polynucleotide: The term "polynucleotide" as used herein refers to polymers of nucleotides of any length, including ribonucleotides, deoxyribonucleotides, analogs thereof, or mixtures thereof. This term refers to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the term "polynucleotide" includes polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide that is an N- or C-glycoside of a purine or pyrimidine base, and other polymers containing normucleotidic backbones, for example, polyamide (e.g., peptide nucleic acids "PNAs") and polymorpholino polymers, and other synthetic sequence-specific nucleic acid polymers providing that the polymers contain nucleobases in a configuration that allows for base pairing and base stacking, such as is found in DNA and RNA. In particular aspects, the polynucleotide comprises an mRNA. In other aspect, the mRNA is a synthetic mRNA. In some aspects, the synthetic mRNA comprises at least one unnatural nucleobase. In some aspects, all nucleobases of a certain class have been replaced with unnatural nucleobases (e.g., all uridines in a polynucleotide disclosed herein can be replaced with an unnatural nucleobase, e.g., 5-methoxyuridine). In some aspects, the polynucleotide (e.g., a synthetic RNA or a synthetic DNA) comprises only natural nucleobases, i.e., A, C, T and U in the case of a synthetic DNA, or A, C, T, and U in the case of a synthetic RNA.

The skilled artisan will appreciate that the T bases in the codon maps disclosed herein are present in DNA, whereas the T bases would be replaced by U bases in corresponding RNAs. For example, a codon-nucleotide sequence disclosed herein in DNA form, e.g., a vector or an in-vitro translation (IVT) template, would have its T bases transcribed as U based in its corresponding transcribed mRNA. In this respect, both sequence-optimized DNA sequences (comprising T) and their corresponding RNA sequences (comprising U) are considered sequence-optimized nucleotide sequence of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn would correspond to a ΨΨC codon (RNA map in which U has been replaced with pseudouridine).

Standard A-T and G-C base pairs form under conditions that allow the formation of hydrogen bonds between the N3-H and C4-oxy of thymidine and the N1 and C6-NH2, respectively, of adenosine and between the C2-oxy, N3 and C4-NH2, of cytidine and the C2-NH2, N'—H and C6-oxy, respectively, of guanosine. Thus, for example, guanosine (2-amino-6-oxy-9-β-D-ribofuranosyl-purine) can be modified to form isoguanosine (2-oxy-6-amino-9-β-D-ribofuranosyl-purine). Such modification results in a nucleoside base that will no longer effectively form a standard base pair with cytosine. However, modification of cytosine (1-β-D-ribofuranosyl-2-oxy-4-amino-pyrimidine) to form isocytosine (1-β-D-ribofuranosyl-2-amino-4-oxy-pyrimidine-) results in a modified nucleotide that will not effectively base pair with guanosine but will form a base pair with isoguanosine (U.S. Pat. No. 5,681,702 to Collins et al., hereby incorporated by reference in its entirety). Isocytosine is available from Sigma Chemical Co. (St. Louis, Mo.); isocytidine can be prepared by the method described by Switzer et al. (1993) Biochemistry 32:10489-10496 and references cited therein; 2'-deoxy-5-methyl-isocytidine can be prepared by the method of Tor et al., 1993, J. Am. Chem. Soc. 115:4461-4467 and references cited therein; and isoguanine nucleotides can be prepared using the method described by Switzer et al., 1993, supra, and Mantsch et al., 1993, Biochem. 14:5593-5601, or by the method described in U.S. Pat. No. 5,780,610 to Collins et al., each of which is hereby incorporated by reference in its entirety. Other nonnatural base pairs can be synthesized by the method described in Piccirilli et al., 1990, Nature 343:33-37, hereby incorporated by reference in its entirety, for the synthesis of 2,6-diaminopyrimidine and its complement (1-methylpyrazolo-[4,3]pyrimidine-5,7-(4H, 6H)-dione. Other such modified nucleotide units that form unique base pairs are known, such as those described in Leach et al. (1992) J. Am. Chem. Soc. 114:3675-3683 and Switzer et al., supra.

Polypeptide: As used herein, "polypeptide" means a polymer of amino acid residues (natural or unnatural) linked together most often by peptide bonds. The term, as used herein, refers to proteins, polypeptides, and peptides of any size, structure, or function. Thus, polypeptides include gene products, naturally occurring polypeptides, synthetic polypeptides, homologs, orthologs, paralogs, fragments and other equivalents, variants, and analogs of the foregoing. A polypeptide can be a single molecule or can be a multi-molecular complex such as a dimer, trimer or tetramer. They can also comprise single chain or multichain polypeptides and can be associated or linked. Most commonly disulfide linkages are found in multichain polypeptides. The term polypeptide can also apply to amino acid polymers in which one or more amino acid residues are an artificial chemical analogue of a corresponding naturally occurring amino acid.

The term polypeptide encompasses an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids such as homocysteine, ornithine, p-acetylphenylalanine, D-amino acids, and creatine), as well as other modifications known in the art.

Polypeptide variant: As used herein, the term "polypeptide variant" refers to molecules that differ in their amino acid sequence from a native or reference sequence. The amino acid sequence variants can possess substitutions, deletions, and/or insertions at certain positions within the amino acid sequence, as compared to a native or reference sequence. Ordinarily, variants will possess at least about 50% identity (homology), at least about 60% identity, at least about 70% identity, at least about 80% identity, at least about 90% identity, at least about 95% identity, at least about 99% identity to a native or reference sequence. In some embodiments, they will be at least about 80%, or at least about 90% identical (homologous) to a native or reference sequence.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as µmol/mL, mmol/mL, etc. divided by the measure in the body fluid.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity that is in a form predicate for that substance, molecule or entity to act as a therapeutic upon chemical or physical alteration. Prodrugs can by covalently bonded or sequestered in some way and that release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune phrophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3$ $\psi$), and 2'-O-methyl-pseudouridine ($\psi$m).

Purified As used herein, "purify," "purified," "purification" means to make substantially pure or clear from unwanted components, material defilement, admixture or imperfection.

Repeated transfection: As used herein, the term "repeated transfection" refers to transfection of the same cell culture with a polynucleotide a plurality of times. The cell culture can be transfected at least twice, at least 3 times, at least 4 times, at least 5 times, at least 6 times, at least 7 times, at least 8 times, at least 9 times, at least 10 times, at least 11 times, at least 12 times, at least 13 times, at least 14 times, at least 15 times, at least 16 times, at least 17 times at least 18 times, at least 19 times, at least 20 times, at least 25 times, at least 30 times, at least 35 times, at least 40 times, at least 45 times, at least 50 times or more.

Sample. As used herein, the term "sample" or "biological sample" refers to a subset of its tissues, cells or component parts (e.g., body fluids, including but not limited to blood, mucus, lymphatic fluid, synovial fluid, cerebrospinal fluid, saliva, amniotic fluid, amniotic cord blood, urine, vaginal fluid and semen). A sample further can include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which can contain cellular components, such as proteins or nucleic acid molecule.

Signal Sequences: As used herein, the phrase "signal sequences" refers to a sequence that can direct the transport or localization of a protein.

Single unit dose: As used herein, a "single unit dose" is a dose of any therapeutic administered in one dose/at one time/single route/single point of contact, i.e., single administration event.

Similarity: As used herein, the term "similarity" refers to the overall relatedness between polymeric molecules, e.g., between polynucleotide molecules (e.g., DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and in some cases capable of formulation into an efficacious therapeutic agent.

Stabilized: As used herein, the term "stabilize," "stabilized," "stabilized region" means to make or become stable.

Stereoisomer: As used herein, the term "stereoisomer" refers to all possible different isomeric as well as conformational forms that a compound can possess (e.g., a compound of any formula described herein), in particular all possible stereochemically and conformationally isomeric forms, all diastereomers, enantiomers and/or conformers of the basic molecular structure. Some compounds of the present disclosure can exist in different tautomeric forms, all of the latter being included within the scope of the present disclosure.

Subject: As used herein, the term "subject" or "patient" refers to any organism to which a composition in accordance with the disclosure can be administered, e.g., for experimental, diagnostic, prophylactic, and/or therapeutic purposes. Typical subjects include animals (e.g., mammals such as mice, rats, rabbits, non-human primates, and humans).

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or can not exhibit symptoms of the disease, disorder, and/or condition but harbors a propensity to develop a disease or its symptoms. In some embodiments, an individual who is susceptible to a disease, disorder, and/or condition (for example, cancer) can be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or polypeptides or other molecules of the present disclosure can be chemical or enzymatic.

Targeted Cells: As used herein, "targeted cells" refers to any one or more cells of interest. The cells can be found in vitro, in vivo, in situ or in the tissue or organ of an organism. The organism can be an animal, for example a mammal, a human or a patient.

Targeting sequence: As used herein, the phrase "targeting sequence" refers to a sequence that can direct the transport or localization of a protein.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr. period. It can be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors can regulate transcription of a target gene alone or in a complex with other molecules.

Transcription: As used herein, the term "transcription" refers to methods to introduce exogenous nucleic acids into a cell. Methods of transfection include, but are not limited to, chemical methods, physical treatments and cationic lipids or mixtures.

Treating: As used herein, the terms "treating" or "treatment" or "therapy" refers to partially or completely alleviating, ameliorating, improving, relieving, delaying onset of, inhibiting progression of, reducing severity of, and/or reducing incidence of one or more symptoms or features of a particular infection, disease, disorder, and/or condition. Treatment can be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule. Molecules can undergo a series of modifications whereby each modified molecule can serve as the "unmodified" starting molecule for a subsequent modification.

Viral protein: As used herein, the phrase "viral protein" means any protein originating from a virus.

X. Cross-Reference to Related Applications

This application claims priority to U.S. Provisional Patent Application No. 62/269,089 filed Dec. 17, 2015, entitled Polynucleotides Encoding Methylmalonyl-CoA Mutase; U.S. Provisional Patent Application No. 62/269,092 filed Dec. 17, 2015, entitled Methods of Using MCM-Encoding Polynucleotides; U.S. Provisional Patent Application No. 62/273,112 filed Dec. 30, 2015, entitled Polynucleotides Encoding Methylmalonyl-CoA Mutase; U.S. Provisional Patent Application No. 62/273,108 filed Dec. 30, 2015, entitled Methods of Using MCM-Encoding Polynucleotides; U.S. Provisional Patent Application No. 62/274,727 filed Jan. 4, 2016, entitled Polynucleotides Encoding Methylmalonyl-CoA Mutase; U.S. Provisional Patent Application No. 62/274,733 filed Jan. 4, 2016, entitled Methods of Using MCM-Encoding Polynucleotides; U.S. Provisional Patent Application No. 62/274,722 filed Jan. 4, 2016, entitled Polynucleotides Encoding Methylmalonyl-CoA Mutase; U.S. Provisional Patent Application No. 62/274,726 filed Jan. 4, 2016, entitled Methods of Using MCM-Enconding Polynucleotides; U.S. Provisional Patent Application No. 62/338,478 filed Can 18, 2016, entitled Polynucleotides Encoding Methylmalonyl-CoA Mutase; U.S. Provisional Patent Application No. 62/338,456 filed Can 18, 2016, entitled Polynucleotides Encoding Methylmalonyl-CoA Mutase; and U.S. Provisional Patent Application No. 62/409,343 filed Oct. 14, 2016, entitled Polynucleotides Encoding Methylmalonyl-CoA Mutase, the contents of each of which are herein incorporated by reference in its entirety.

XI. Reference to Sequence Listing Submitted Electronically

The content of the electronically submitted sequence listing (Name: "3529_052PC07_SeqListing_ST25.txt"; Size: 1,080,572 bytes; and date of creation: Dec. 16, 2016) filed herewith the application is incorporated by reference in its entirety.

XII. Equivalents and Scope

Those skilled in the art will recognize, or be able to ascertain using no more than routine experimentation, many equivalents to the specific embodiments in accordance with the disclosure described herein. The scope of the present disclosure is not intended to be limited to the above Description, but rather is as set forth in the appended claims.

In the claims, articles such as "a," "an," and "the" can mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the disclosure, to the tenth of the unit of the lower limit of the range, unless the context clearly dictates otherwise.

In addition, it is to be understood that any particular embodiment of the present disclosure that falls within the prior art can be explicitly excluded from any one or more of the claims. Since such embodiments are deemed to be known to one of ordinary skill in the art, they can be excluded even if the exclusion is not set forth explicitly herein. Any particular embodiment of the compositions of the disclosure (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1. Chimeric Polynucleotide Synthesis

Triphosphate Route

Two regions or parts of a chimeric polynucleotide can be joined or ligated using triphosphate chemistry. According to this method, a first region or part of 100 nucleotides or less can be chemically synthesized with a 5' monophosphate and terminal 3'desOH or blocked OH. If the region is longer than 80 nucleotides, it can be synthesized as two strands for ligation.

If the first region or part is synthesized as a non-positionally modified region or part using in vitro transcription (IVT), conversion the 5'monophosphate with subsequent capping of the 3' terminus can follow. Monophosphate protecting groups can be selected from any of those known in the art.

The second region or part of the chimeric polynucleotide can be synthesized using either chemical synthesis or IVT methods. IVT methods can include an RNA polymerase that can utilize a primer with a modified cap. Alternatively, a cap of up to 80 nucleotides can be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then such region or part can comprise a phosphate-sugar backbone.

Ligation can then be performed using any known click chemistry, orthoclick chemistry, solulink, or other bioconjugate chemistries known to those in the art.

Synthetic Route

The chimeric polynucleotide can be made using a series of starting segments. Such segments include:

(a) Capped and protected 5' segment comprising a normal 3'OH (SEG. 1)
(b) 5' triphosphate segment which can include the coding region of a polypeptide and comprising a normal 3'OH (SEG. 2)
(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) can be treated with cordycepin and then with pyrophosphatase to create the 5'monophosphate.

Segment 2 (SEG. 2) can then be ligated to SEG. 3 using RNA ligase. The ligated polynucleotide can then be purified and treated with pyrophosphatase to cleave the diphosphate. The treated SEG. 2-SEG. 3 construct is then purified and SEG. 1 is ligated to the 5' terminus. A further purification step of the chimeric polynucleotide can be performed.

Where the chimeric polynucleotide encodes a polypeptide, the ligated or joined segments can be represented as: 5'UTR (SEG. 1), open reading frame or ORF (SEG. 2) and 3'UTR+PolyA (SEG. 3).

The yields of each step can be as much as 90-95%.

Example 2: PCR for cDNA Production

PCR procedures for the preparation of cDNA can be performed using 2×KAPA HIFI™ HotStart ReadyMix by Kapa Biosystems (Woburn, Mass.). This system includes 2×KAPA ReadyMix12.5 µl; Forward Primer (10 µM) 0.75 µl; Reverse Primer (10 µM) 0.75 µl; Template cDNA-100 ng; and dH$_2$O diluted to 25.0 l. The PCR reaction conditions can be: at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant disclosure can incorporate a poly-T$_{120}$ for a poly-A$_{120}$ in the mRNA. Other reverse primers with longer or shorter poly(T) tracts can be used to adjust the length of the poly(A) tail in the polynucleotide mRNA.

The reaction can be cleaned up using Invitrogen's PURELINK™ PCR Micro Kit (Carlsbad, Calif.) per manufacturer's instructions (up to 5 µg). Larger reactions will require a cleanup using a product with a larger capacity. Following the cleanup, the cDNA can be quantified using the NANODROP™ and analyzed by agarose gel electrophoresis to confirm the cDNA is the expected size. The cDNA can then be submitted for sequencing analysis before proceeding to the in vitro transcription reaction.

Example 3. In Vitro Transcription (IVT)

The in vitro transcription reactions can generate polynucleotides containing uniformly modified polynucleotides. Such uniformly modified polynucleotides can comprise a region or part of the polynucleotides of the disclosure. The input nucleotide triphosphate (NTP) mix can be made using natural and un-natural NTPs.

A typical in vitro transcription reaction can include the following:
1 Template cDNA—1.0 µg
2 10× transcription buffer (400 mM Tris-HCl pH 8.0, 190 mM MgCl$_2$, 50 mM DTT, 10 mM Spermidine)—2.0 µl
3 Custom NTPs (25 mM each)—7.2 µl
4 RNase Inhibitor—20 U
5 T7 RNA polymerase—3000 U
6 dH$_2$O—Up to 20.0 µl. and
7 Incubation at 37° C. for 3 hr-5 hrs.

The crude IVT mix can be stored at 4° C. overnight for cleanup the next day. 1 U of RNase-free DNase can then be used to digest the original template. After 15 minutes of incubation at 37° C., the mRNA can be purified using Ambion's MEGACLEAR™ Kit (Austin, Tex.) following the manufacturer's instructions. This kit can purify up to 500 µg of RNA. Following the cleanup, the RNA can be quantified using the NanoDrop and analyzed by agarose gel electrophoresis to confirm the RNA is the proper size and that no degradation of the RNA has occurred.

Example 4. Enzymatic Capping

Capping of a polynucleotide can be performed with a mixture includes: IVT RNA 60 µg-180 µg and dH$_2$O up to 72 µl. The mixture can be incubated at 65° C. for 5 minutes to denature RNA, and then can be transferred immediately to ice.

The protocol can then involve the mixing of 10× Capping Buffer (0.5 M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The polynucleotide can then be purified using Ambion's MEGACLEAR™ Kit (Austin, Tex.) following the manufacturer's instructions. Following the cleanup, the RNA can be quantified using the NANODROP™ (ThermoFisher, Waltham, Mass.) and analyzed by agarose gel electrophoresis to confirm the RNA is the proper size and that no degradation of the RNA has occurred. The RNA product can also be sequenced by running a reverse-transcription-PCR to generate the cDNA for sequencing.

Example 5. PolyA Tailing Reaction

Without a poly-T in the cDNA, a poly-A tailing reaction must be performed before cleaning the final product. This can be done by mixing Capped IVT RNA (100 µl); RNase Inhibitor (20 U); 10× Tailing Buffer (0.5 M Tris-HCl (pH 8.0), 2.5 M NaCl, 100 mM MgCl$_2$)(12.0 µl); 20 mM ATP (6.0 µl); Poly-A Polymerase (20 U); dH$_2$O up to 123.5 µl and incubating at 37° C. for 30 min. If the poly-A tail is already in the transcript, then the tailing reaction can be skipped and proceed directly to cleanup with Ambion's MEGACLEAR™ kit (Austin, Tex.) (up to 500 µg). Poly-A Polymerase is, in some cases, a recombinant enzyme expressed in yeast.

It should be understood that the processivity or integrity of the polyA tailing reaction does not always result in an exact size polyA tail. Hence polyA tails of approximately between 40-200 nucleotides, e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the disclosure.

Example 6. Natural 5' Caps and 5' Cap Analogues

5'-capping of polynucleotides can be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5')ppp(5')A; G(5')ppp(5')G; m7G(5')ppp(5')A; m7G(5')ppp (5')G (New England BioLabs, Ipswich, Mass.). 5'-capping of modified RNA can be completed post-transcriptionally using a Vaccinia Virus Capping Enzyme to generate the "Cap 0" structure: m7G(5')ppp(5')G (New England BioLabs, Ipswich, Mass.). Cap 1 structure can be generated using both Vaccinia Virus Capping Enzyme and a 2'-O methyl-transferase to generate: m7G(5')ppp(5')G-2'-O-methyl. Cap 2 structure can be generated from the Cap 1 structure followed by the 2'-O-methylation of the 5'-antepenultimate nucleotide using a 2'-O methyl-transferase. Cap 3 structure can be generated from the Cap 2 structure followed by the 2'-O-methylation of the 5'-preantepenultimate nucleotide using a 2'-O methyl-transferase. Enzymes can be derived from a recombinant source.

When transfected into mammalian cells, the modified mRNAs can have a stability of between 12-18 hours or more than 18 hours, e.g., 24, 36, 48, 60, 72 or greater than 72 hours.

Example 7. Capping Assays

A. Protein Expression Assay

Polynucleotides encoding a polypeptide, containing any of the caps taught herein, can be transfected into cells at equal concentrations. After 6, 12, 24 and 36 hours post-transfection, the amount of protein secreted into the culture medium can be assayed by ELISA. Synthetic polynucleotides that secrete higher levels of protein into the medium would correspond to a synthetic polynucleotide with a higher translationally-competent Cap structure.

B. Purity Analysis Synthesis

Polynucleotides encoding a polypeptide, containing any of the caps taught herein, can be compared for purity using denaturing Agarose-Urea gel electrophoresis or HPLC analysis. Polynucleotides with a single, consolidated band by electrophoresis correspond to the higher purity product compared to polynucleotides with multiple bands or streaking bands. Synthetic polynucleotides with a single HPLC peak would also correspond to a higher purity product. The capping reaction with a higher efficiency would provide a more pure polynucleotide population.

C. Cytokine Analysis

Polynucleotides encoding a polypeptide, containing any of the caps taught herein, can be transfected into cells at multiple concentrations. After 6, 12, 24 and 36 hours post-transfection the amount of pro-inflammatory cytokines such as TNF-alpha and IFN-beta secreted into the culture medium can be assayed by ELISA. Polynucleotides resulting in the secretion of higher levels of pro-inflammatory cytokines into the medium would correspond to polynucleotides containing an immune-activating cap structure.

D. Capping Reaction Efficiency

Polynucleotides encoding a polypeptide, containing any of the caps taught herein, can be analyzed for capping reaction efficiency by LC-MS after nuclease treatment. Nuclease treatment of capped polynucleotides would yield a mixture of free nucleotides and the capped 5'-5-triphosphate cap structure detectable by LC-MS. The amount of capped product on the LC-MS spectra can be expressed as a percent of total polynucleotide from the reaction and would correspond to capping reaction efficiency. The cap structure with higher capping reaction efficiency would have a higher amount of capped product by LC-MS.

Example 8. Agarose Gel Electrophoresis of Modified RNA or RT PCR Products

Individual polynucleotides (200-400 ng in a 20 μl volume) or reverse transcribed PCR products (200-400 ng) can be loaded into a well on a non-denaturing 1.2% Agarose E-Gel (Invitrogen, Carlsbad, Calif.) and run for 12-15 minutes according to the manufacturer protocol.

Example 9. Nanodrop Modified RNA Quantification and UV Spectral Data

Modified polynucleotides in TE buffer (1 μl) can be used for Nanodrop UV absorbance readings to quantitate the yield of each polynucleotide from an chemical synthesis or in vitro transcription reaction.

Example 10. Formulation of Modified mRNA Using Lipidoids

Polynucleotides can be formulated for in vitro experiments by mixing the polynucleotides with the lipidoid at a set ratio prior to addition to cells. In vivo formulation can require the addition of extra ingredients to facilitate circulation throughout the body. To test the ability of these lipidoids to form particles suitable for in vivo work, a standard formulation process used for siRNA-lipidoid formulations can be used as a starting point. After formation of the particle, polynucleotide can be added and allowed to integrate with the complex. The encapsulation efficiency can be determined using a standard dye exclusion assays.

Example 11. Method of Screening for Protein Expression

A. Electrospray Ionization

A biological sample that can contain proteins encoded by a polynucleotide administered to the subject can be prepared and analyzed according to the manufacturer protocol for electrospray ionization (ESI) using 1, 2, 3 or 4 mass analyzers. A biologic sample can also be analyzed using a tandem ESI mass spectrometry system.

Patterns of protein fragments, or whole proteins, can be compared to known controls for a given protein and identity can be determined by comparison.

B. Matrix-Assisted Laser Desorption/Ionization

A biological sample that can contain proteins encoded by one or more polynucleotides administered to the subject can be prepared and analyzed according to the manufacturer protocol for matrix-assisted laser desorption/ionization (MALDI).

Patterns of protein fragments, or whole proteins, can be compared to known controls for a given protein and identity can be determined by comparison.

C. Liquid Chromatography-Mass Spectrometry-Mass Spectrometry

A biological sample, which can contain proteins encoded by one or more polynucleotides, can be treated with a trypsin enzyme to digest the proteins contained within. The resulting peptides can be analyzed by liquid chromatography-mass spectrometry-mass spectrometry (LC/MS/MS). The peptides can be fragmented in the mass spectrometer to yield diagnostic patterns that can be matched to protein sequence databases via computer algorithms. The digested sample can be diluted to achieve 1 ng or less starting material for a given protein. Biological samples containing a simple buffer background (e.g., water or volatile salts) are amenable to direct in-solution digest; more complex backgrounds (e.g., detergent, non-volatile salts, glycerol) require an additional clean-up step to facilitate the sample analysis.

Patterns of protein fragments, or whole proteins, can be compared to known controls for a given protein and identity can be determined by comparison.

Example 12. Synthesis of mRNA Encoding MCM

The sequence optimized polynucleotides encoding MCM polypeptides, i.e., SEQ ID NOs: 1-207, 732-765, and 772, are synthesized as described in Examples 1 to 12.

Further, mRNA's encoding both mouse MCM and human MCM were prepared for Examples 13-19 described below, and they were synthesized as described in Examples 1 to 12.

An mRNA encoding human MCM ("hMCM-mRNA") was constructed that encodes the naturally-occurring V671 mutation of MCM. The nucleotide sequence of hMCM-mRNA is provided in SEQ ID NO: 249. The hMCM-mRNA sequence includes both 5' and 3' UTR regions (SEQ ID NOs: 266 and 267, respectively):

5'UTR: TCAAGCTTTTGGACCCTCGTACAGAAGCTAATACGACTCACTA

TAGGGAAATAAGAGAGAAAAGAAGAGTAAGAAGAAATATAAGAGCCACC

3'UTR: TGATAATAGGCTGGAGCCTCGGTGGCCATGCTTCTTGCCCCTT

GGGCCTCCCCCCAGCCCCTCCTCCCCTTCCTGCACCCGTACCCCCGTGGT

CTTTGAATAAAGTCTGAGTGGGCGGC

A mRNA encoding mouse MCM ("mMCM-mRNA") was also constructed using standard molecular biology techniques. The nucleotide sequence of mMCM-mRNA is provided in SEQ ID NO: 250, and it encodes mouse MCM (SEQ ID NO: 268). The mMCM-mRNA sequence includes the same 5' and 3' UTR regions as hMCM-mRNA.

Both hMCM-mRNA and mMCM-mRNA were prepared as modified mRNA. Specifically, during in vitro translation, modified mRNA was generated using 1-methyl-pseudoUTP to ensure that the mRNAs contained 100% 1-methyl-pseudouridine instead of uridine. Further, both hMCM-mRNA and mMCM-mRNA were synthesized with a primer that introduced a 100 nucleotide polyA-tail, and a Cap 1 structure was generated on both mRNAs using Vaccinia Virus Capping Enzyme and a 2'-O methyl-transferase to generate: m7G(5')ppp(5')G-2'-O-methyl.

Example 13. Detecting Endogenous MCM Expression In Vitro

MCM expression was characterized in a variety of cell lines, including cells derived from both mice and human sources. The cell lines tested included Hepa1-6 (mouse), HepG2 (human), SNU423 (human), and HeLa cells. Cell were cultured in standard conditions and cell extracts were obtained by placing the cells in lysis buffer. For comparison purposes, a mitochondrial extract from mouse liver was also prepared. To prepare the liver extract, whole liver was homogenized in an ice-cold sucrose-containing hypotonic buffer at neutral pH adjusted with 0.1 molarTrizma base-MOPS (3-(N-morpholino)propanesulfonic acid). The liver homogenates were centrifuged at 600 g in a cold table-top centrifuge to remove the nuclear fraction. The mitochondrial fraction was then collected by centrifugation of the cleared lysates at 7000 g.

To analyze MCM expression, 15 µg of each lysate was prepared in a 40 µL volume with lithium dodecyl sulfate sample loading buffer and subjected to standard Western blot analysis. For detection of MCM, the antibody used was anti-methylmalonyl-CoA mutase (mouse polyclonal; Ab67869; ABCAM®) at a 1:1000 dilution. For detection of a load control, the antibody used was anti-citrase synthase (rabbit polyclonal; PA5-22126; Thermo-Fisher SCIENTIFIC®). In FIG. 1, the signal provided by anti-MCM is provided in green, while the anti-citrate synthase signal is provided in red. FIG. 1 shows that MCM was found in all cell lines tested, including both mouse and human liver-derived cell lines. For all cell lines, the expression of MCM was in roughly the same proportion to the control citrate synthase signal, though less signal was observed in HeLa cells. FIG. 1 also shows that the cell lines expressed MCM at a level comparable to mouse liver mitochondrial mitochondrial extract.

Figure 2A:
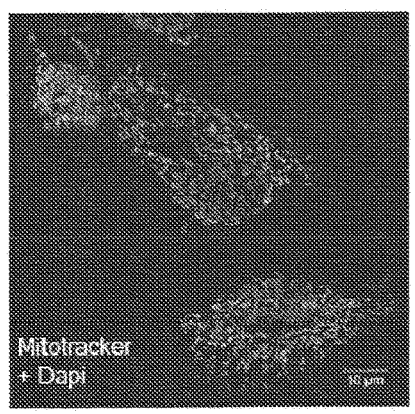
FIGS. 2A-2C show immunofluorescence analyses of the localization of endogenous methylmalonyl-CoA mutase in HeLa cells.
Figure 2B:
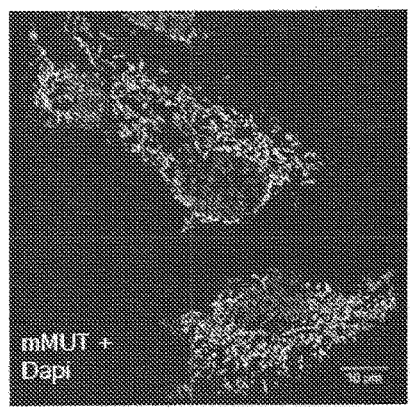
Figure 2C:
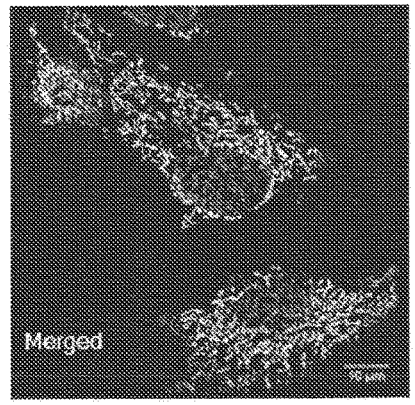

To examine the localization of endogenous MCM, immunofluorescence analysis was performed on HeLa cells. MCM expression was detected using anti-methylmalonyl-CoA mutase (mouse monoclonal; Ab67869; ABCAM®), mitochondria were detected using Mitotracker, and the nucleus was stained with DAPI. Image analysis was performed on a Zeiss ELYRA imaging system. As seen in FIGS. 2(A)-(C), the HeLa immunofluorescent staining reveals extensive colocalization between mitochondria (red) and MCM immunofluorescence (green), with little to no colocalization between the nucleus (DAPI stain) and MCM. The finding that the majority of endogenous MCM localizes with mitochondria is consistent with MCM's known metabolic function and localization.

Example 14. In Vitro Expression of MCM in HeLa Cells

To measure in vitro expression of human MCM in HeLa cells, those cells were seeded on 12-well plates (BD Biosciences, San Jose, USA) one day prior to transfection. mRNA formulations comprising human MCM (SEQ ID NO: 249) or a GFP control (encoding SEQ ID NO: 269) were transfected using 800 ng mRNA and 2 µL Lipofectamin 2000 in 60 µL OPTI-MEM per well and incubated. After 24 hours, the cells in each well were lysed using a consistent amount of lysis buffer. For comparison purposes, mouse liver mitochondrial extract was also prepared as described in Example 13. Protein concentrations of each were determined using a BCA assay according to manufacturer's instructions. To analyze MCM expression, equal load of each lysate (24 µg) was prepared in a loading buffer and subjected to standard Western blot analysis. For detection of MCM, the antibody used was anti-methylmalonyl-CoA mutase (rabbit monoclonal; ab133672; Abcam®) at a 1:1000 dilution.

Figure 3:
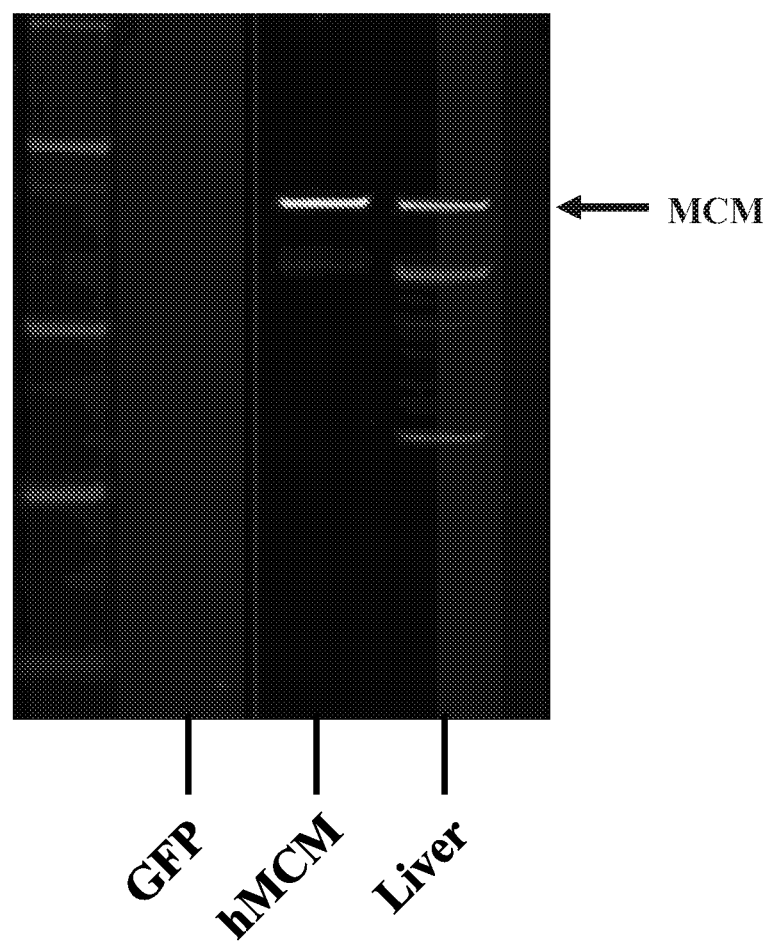
FIG. 3 is a Western blot analysis comparing methylmalonyl-CoA mutase expression in (i) HeLa cells transfected with a control GFP expression construct, (ii) HeLa cells transfected with a construct for expressing methylmalonyl-CoA mutase, and (iii) a mouse liver mitochondrial extract.

The resulting Western blot, shown in FIG. 3, demonstrates that introduction of a mRNA formulation comprising hMCM sequence (SEQ ID NO: 249) greatly increased the level of MCM expression in HeLa cells relative to cells transfected with a control construct. The MCM expression level observed after introduction of mRNA encoding MCM were even higher than the levels present in liver mitochondrial mitochondrial extract. While FIG. 1 indicates that at least some endogenous MCM is present in HeLa cells, FIG. 3 shows that the MCM expression levels far exceed that baseline after introduction of mRNAs comprising hMCM.

Example 15. In Vitro MCM Activity in HeLa Cells

While the Western blots of FIG. 3 demonstrate that MCM is expressed after introduction of mRNA comprising an MCM sequence, FIG. 3 does not address whether the exogenously-expressed MCM is active. To answer this question, an in vitro MCM activity assay was performed.

A. Expression

HeLa cells were transfected with mRNA formulations comprising human MCM (SEQ ID NO: 249) or a GFP control (encoding SEQ ID NO: 269) were transfected with Lipofectamin 2000 and lysed as described in Example 14 above. For comparison purposes, mouse liver mitochondrial extract was also prepared as described in Example 13 above.

B. Activity Assay

To assess whether exogenous MCM can function, an in vitro activity assay was performed using transfected HeLa cell lysates as the source of enzymatic activity. To begin, 60 µL of lysate containing 132 µg protein was mixed with 30 µL of MCM coenzyme adocobalimin (1 mM in distilled water) at 37° C. for 5 minutes. Equal amounts of DL-2-[methyl-$^{14}$C]-methylmalonyl-CoA (50-60 mCi per mmol; Cat ARC0847; American Radiolabeled Chemicals) were then added to each reaction, which was further incubated at 37° C. for 10 minutes. The reaction was stopped by adding 50 µL of 100 g/L TCA and vortexing. The reaction tubes were then centrifuged at 13,000 g for 1 min, and the supernatant was analyzed for the presence of [$^{14}$C]-succinyl-CoA using HPLC-based separation and quantification. Specifically, 20 µL of each activity reaction supernatant was analyzed using a HPLC system equipped with a Quaternary-Pump, a Multi-sampler, a Thermostated Column-Compartment, a Poroshell EC-C18 120 HPLC-column and a Radiometric Detector controlled by OpenLAB Chromatography Data System, all used according to the manufacturers' recommendations. Elusion was with a linear methanol gradient: 0-15 min (Solvent A: 95% 100 mM acetic acid in 100 mM sodium phosphate buffer, pH 7.0) and 15-25 min (95% Solvent A with 5% of an 18% v/v methanol/water solution) with a flow rate of 0.5 mL/min.

Figure 4:
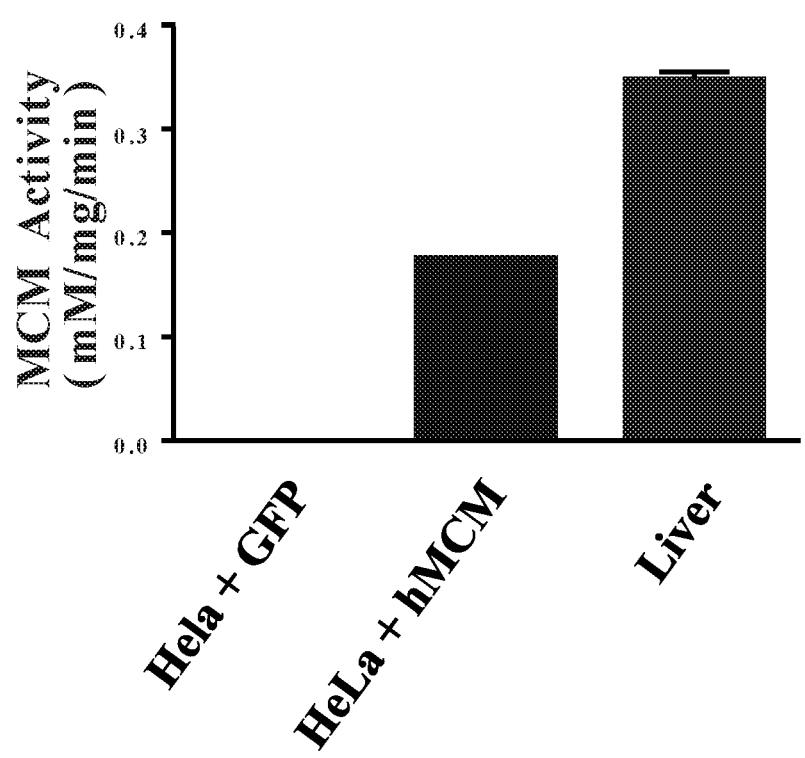
FIG. 4 is a comparison of methylmalonyl-CoA mutase enzymatic activity in (i) HeLa cells transfected with a control GFP expression construct, (ii) HeLa cells transfected with a construct for expressing methylmalonyl-CoA mutase, and (iii) a mouse liver mitochondrial extract.

FIG. 4 shows that there was very low to no MCM activity detected in control transfected HeLa cells. FIG. 4 also shows, however, that transfection with mRNA encoding hMCM led to MCM activity of almost 0.2 mM/min/mg. The MCM activity of cell lysate generated by transfection with mRNA encoding hMCM was roughly half of that observed in mouse liver mitochondrial extract.

Example 16. Measuring In Vitro Expression of MCM

Hepa1-6 cells and fibroblasts from normal subject (NHDF) and MMA patients (GM50 and GM1673) were examined for their capacity to express exogenous MCM.

Cells were transfected with mRNA formulations comprising human MCM (SEQ ID NO: 249), mouse MCM (SEQ ID NO: 250), or a GFP control (encoding SEQ ID NO: 269) via electroporation using a standard protocol. Each construct was tested separately. After 24 hours incubation, cells were lysed and protein concentration in each lysate was measured by BCA assay. To analyze MCM expression, equal load of each lysate (26 µg) was prepared in a loading buffer and subjected to standard Western blot analysis. For detection of MCM, the antibody used was anti-methylmalonyl-CoA mutase (mouse monoclonal; Anti-MUT TRUEMAB Antibody Clone OTI2C8; OriGene®) at a 1:5000 dilution. For detection of a load control, the antibody used was anti-citrase synthase (rabbit polyclonal; MA5-17625; Pierce®).

Figure 5:
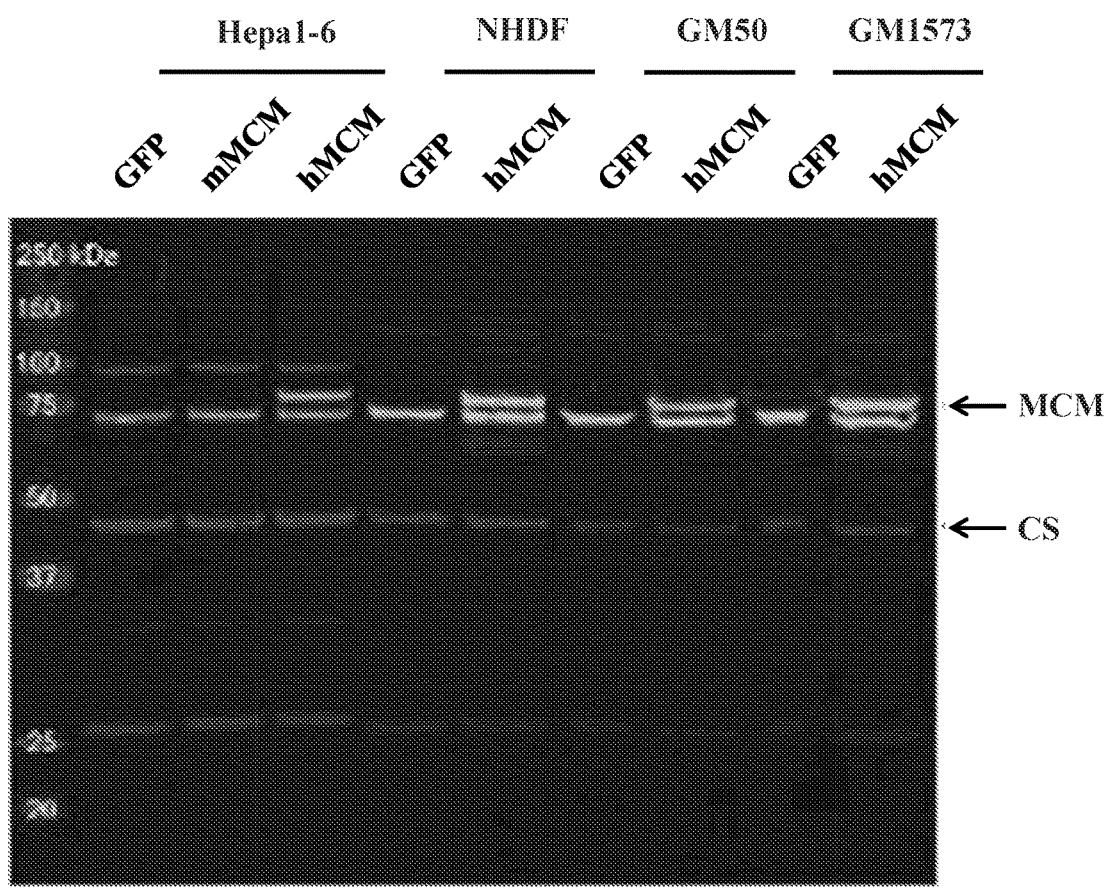
FIG. 5 is a Western blot analysis of methylmalonyl-CoA mutase expression in Hepa1-6 cells, fibroblasts from normal human subjects (NHDF), and fibroblasts from MMA patients (GM50 and GM1573) that were transfected with control mRNA, human MCM mRNA, or mouse MCM mRNA.

FIG. 5 shows that introduction of formulations containing a human MCM sequence (SEQ ID NO: 249) greatly increased the level of MCM expression in normal human cells and in cells from MMA patients, relative to cells transfected with a control construct. The increased MCM expression level observed after introduction of mRNA encoding hMCM were reflected in the appearance in FIG. 5 of an MCM band in cells transfected with mRNA encoding hMCM. While no significant difference in MCM levels was noted after transfection with mouse MCM (SEQ ID NO: 250), this could be due to a specific interaction of the MCM antibody with only the human form of the enzyme.

Figure 6A:
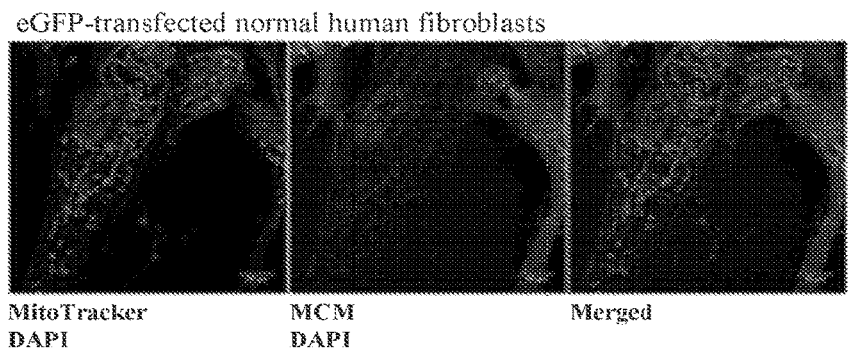
FIGS. 6A-6D show immunofluorescence analyses of the localization of exogenously expressed methylmalonyl-CoA mutase in human fibroblasts transfected with eGFP mRNAs or MCM mRNAs (also referred to as "MUT"). The left panels show the location of mitochondria using Mitotracker and the nucleus using DAPI, the middle panels show shows the location of mitochondria using MCM protein and the nucleus using DAPI, and the right panels show merged images of the left panel and the right panel.
Figure 6B:
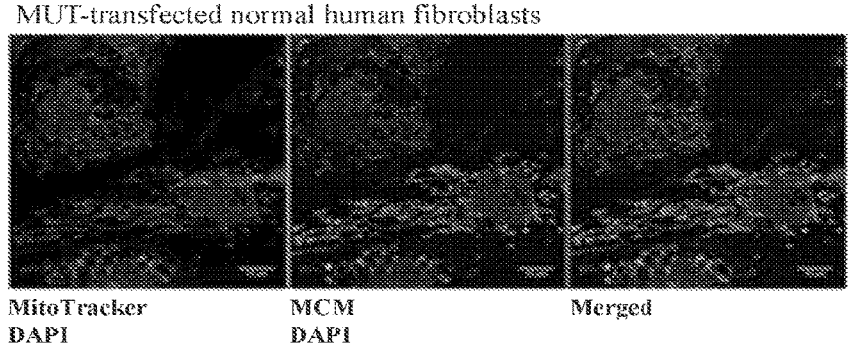
Figure 6C:
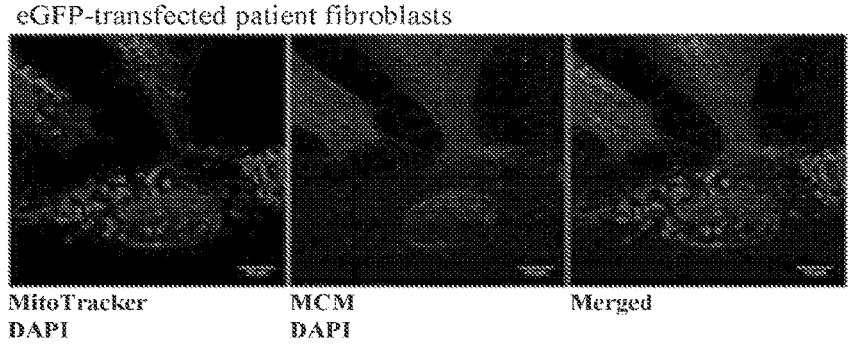
Figure 6D:
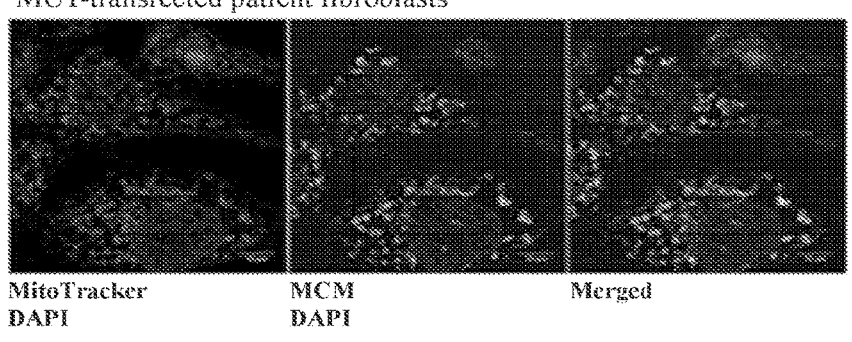

FIGS. 6A-6D show co-localization of MCM and mitochondria in human fibroblasts transfected with eGFP or MCM mRNAs. To examine the localization of mRNA-encoded hMCM in mitochondria, 1×10$^6$ MCM-deficient patient fibroblasts (GM01673) were transfected with 1 µg of hMCM mRNA. 24 hours after transfection, the cells were incubated with 200 nM MitoTracker Red CMXR$_{OS}$ (M7512, ThermoFisher Scientific) for 30 min to mark mitochondria and stained with anti-MCM mouse mAb (TA506873, Origene) to examine the cellular localization.). FIGS. 6A and 6C are images taken of patient fibroblasts transfected with mRNA encoding eGFP. FIGS. 6B and 6D are images taken of patient fibroblasts transfected with mRNA encoding hMCM. A co-localization of MCM and mitochondria was observed, suggesting expressed MCM proteins reside inside mitochondria.

Example 17. Measuring In Vitro MCM Activity

A. Expression

Hepa1-6 cells and fibroblasts from normal human subject (NHDF) and MMA patients (GM50 and GM1673) were cultured. Cells were transfected with mRNA formulations comprising human MCM (SEQ ID NO: 249), mouse MCM (SEQ ID NO: 250), or a GFP control (encoding SEQ ID NO: 269) via electroporation using a standard protocol.

B. Activity Assay

To assess whether exogenous MCM can function, an in vitro activity assay was performed using transfected cell lysates as the source of enzymatic activity. To begin, 60 µL of lysate containing 100 µg protein was mixed with 30 µL of MCM coenzyme adocobalimin (1 mM in distilled water) at 37° C. for 5 minutes. Equal amounts of DL-2-[methyl-$^{14}$C]-methylmalonyl-CoA (50-60 mCi per mmol; Cat ARC0847; American Radiolabeled Chemicals) were then added to each reaction, which was further incubated at 37° C. for 10 minutes. The reaction was stopped by adding 50 µL of 100 g/L TCA and vortexing. The reaction tubes were then centrifuged at 13,000 g for 1 min, and the supernatant was analyzed for the presence of [$^{14}$C]-succinyl-CoA using HPLC-based separation and quantification. Specifically, 20 µL of each activity reaction supernatant was analyzed using a HPLC system equipped with a Quaternary-Pump, a Multi-sampler, a Thermostated Column-Compartment, a Poroshell EC-C18 120 HPLC-column and a Radiometric Detector controlled by OpenLAB Chromatography Data System, all used according to the manufacturers' recommendations. Elusion was with a linear methanol gradient: 0-15 min (Solvent A: 95% 100 mM acetic acid in 100 mM sodium phosphate buffer, pH 7.0) and 15-25 min (95% Solvent A with 5% of an 18% v/v methanol/water solution) with a flow rate of 0.5 mL/min.

Figure 7:
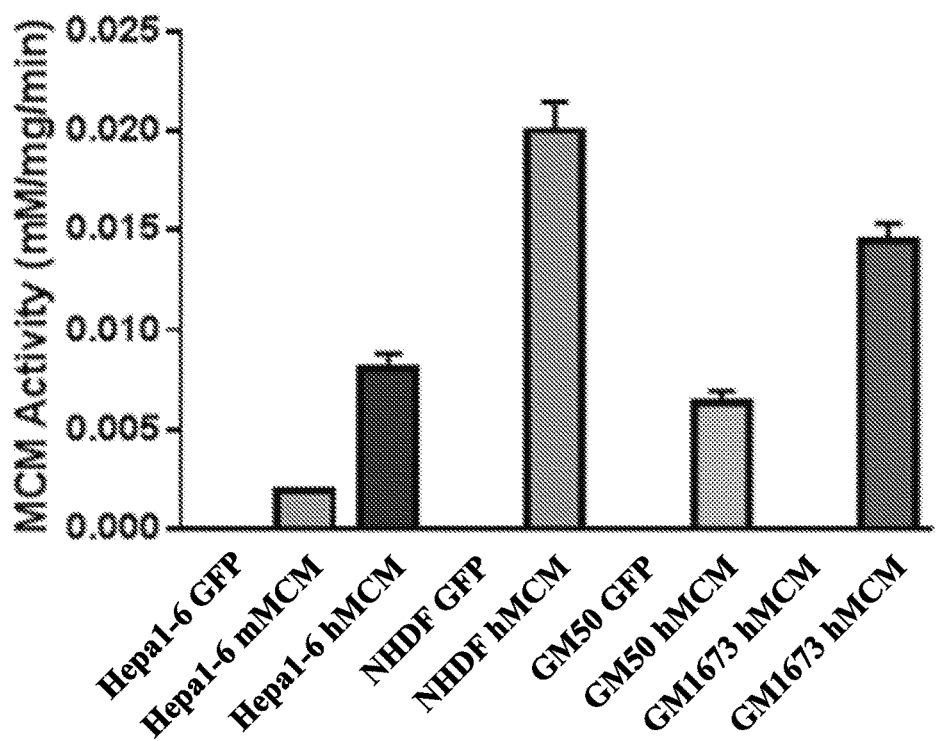
FIG. 7 is measurement of methylmalonyl-CoA mutase activity in Hepa1-6 cells, fibroblasts from normal human subjects (NHDF), and fibroblasts from MMA patients (GM50 and GM1573) that were transfected with control mRNA, human MCM mRNA, or mouse MCM mRNA.

FIG. 7 shows that, for each cell lines tested, transfection with mRNA's encoding either mouse MCM or human MCM increased the level of MCM activity in all cell types tested. Thus this data demonstrates that transfection of mRNA encoding MCM leads to the expression of active MM enzyme in Hepa1-6 cells, fibroblasts from normal human subjects, and fibroblasts from MMA patients. Further, human MCM increased MCM activity to a greater degree than did mouse MCM when transfected into Hepa1-6 cells.

Example 18. Increased In Vivo MCM Expression

To assess the ability of MCM-containing mRNA's to facilitate MCM expression in vivo, mRNA encoding human MCM (SEQ ID NO: 249) was introduced into C57B/L6 mice. C57B/L6 mice were injected intravenously with either control mRNA (NT-FIX) or hMCM mRNA at 0.5 mg/kg. The mRNA was formulated in lipid nanoparticles for delivery into the mice. Mice were sacrificed after 24 or 48 hrs. and MCM protein levels in liver lysates were determined by capillary electrophoresis (CE). Citrate synthase expression was examined for use as a loading control. For control NT-FIX injections, 4 mice were tested for each time point. For hMCM mRNA injections, 6 mice were tested for each time point.

Figure 8A:
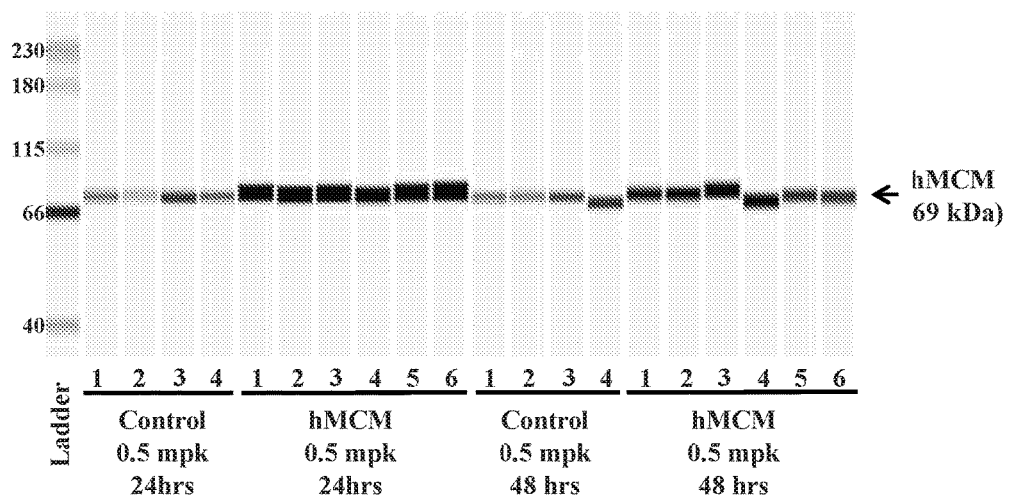
FIGS. 8A-8B is an analysis of in vivo treatment with mRNA encoding methylmalonyl-CoA mutase. For FIGS. 8A and 8B, C57B/L6 mice were injected intravenously with either control mRNA (NT-FIX) or MCM mRNA at 0.5 mg mRNA/kg body weight ("mpk"). Mice were sacrificed after 24 or 48 hours and MCM protein in mitochondria from livers were determined by capillary electrophoresis (CE). The upper panel (FIG. 8A) shows injection of MCM mRNA increased MCM protein expression after 24 and 48 hours, while the lower panel (FIG. 8B) shows the expression of the control protein citrate synthase.
Figure 8B:
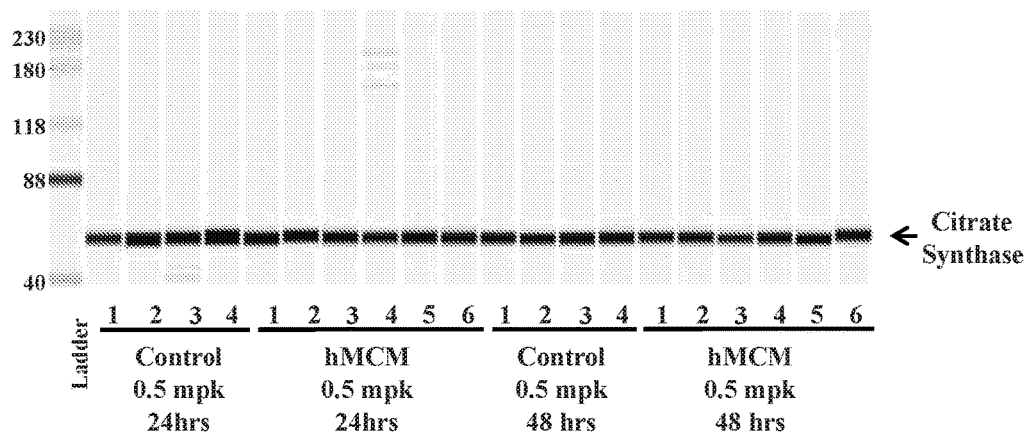

As shown in FIGS. 8A and 8B, MCM expression was drastically increased in all mice injected with mRNA encoding human MCM. The MCM expression peaked at the 24 hour time point, and was still higher than control mice at 48 hours. Relatively low levels of variance were observed between mice of each experimental condition, indicating that treatment with mRNA encoding MCM is capable of reliably inducing expression of MCM.

Example 19. Human MCM Mutant Constructs

According to the present disclosure, the polynucleotide can comprise at least a first region of linked nucleosides encoding human MCM. Exemplary human MCM protein sequences of the present disclosure are listed in Table 3 above.

Example 20. MMA Levels and Body Weight Change in MCK Mouse Model

A MCK mouse model of MMA (Mut−/−;Tg$^{INS-MCK-Mut}$) is known in the literature and lacks exon 3 of the MCM allele, which encodes the substate-binding pocket of MCM. Manoli 2013 (*PNAS* 110(33):13552-13557 (2013); and Harrington et al., "Stable Isotope Breath Tests to Assess Metabolite Flux in Methylmalonic Acidemia (MMA)", American Society of Human Genetics, Abstract, 2014, which are incorporated herein by reference in their entireties. The MCM knockout mice exhibit a semipenetrant neonatal lethal phenotype, with most mice perishing in the early neonatal period. This mouse model is described in WO 2014/143884 A2, hereby incorporated by reference in its entirety. Because the severe phenotype associated with the knockout makes study difficult, researchers have prepared partial rescues of the MCM knockout mice by transgenic rescue with tissue-specific expression or expression of mutants that mimic those mutations associated with human MMA. For example, transgenic mice that express MCM in the knockout background under the control of the muscle-specific creatine kinase promoter ("the MCK mice") survive but still display severe metabolic perturbations and growth abnormalities.

The effectiveness of mRNA encoding human MCM was assessed in the MCK mouse model of MMA (Mut−/−; Tg$^{INS-MCK-Mut}$), N=3-4. MCK mice were injected intravenously with either control mRNA (NT-FIX) or codon optimized human MCM mRNA at 0.16 mg/kg. Five (5) injections were done with MCM mRNA (SEQ ID NO: 734, FIG. 9) at 0.16 mg/kg; and two injections were done with MCM mRNA (SEQ ID NO: 735, FIG. 10) at 0.2 mg/kg. The mRNA was formulated in lipid nanoparticles (Compound 18) for delivery into the mice via tail vein injection. Plasma was collected twice a week, 3 and 6 days after dosing. Plasma MMA was determined by LC-MS/MS. Body weight was measured twice a week at time of dosing. Mice were not sacrificed at the end of this study and were used for other studies. On the third scheduled injection (day 15), one of the mice that had previously been administered control mRNA was switched to being administered hMCM mRNA and the other mouse administered control mRNA was found dead. This testing demonstrated that repeat intravenous dosing of hMCM mRNA corrected biochemical and growth abnormalities in an animal model of Methylmalonic acidemia (MMA-emia).

Figure 16A:
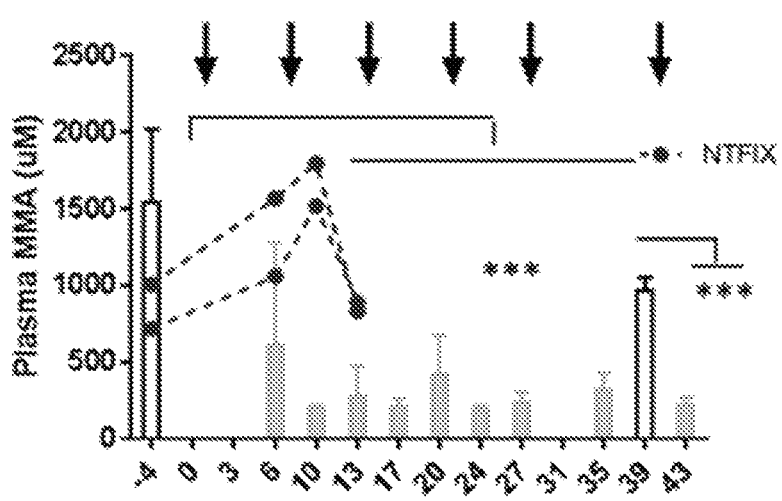
FIGS. 16A-C show analysis of MMA levels and body weight in the MCK mouse model.
Figure 16B:
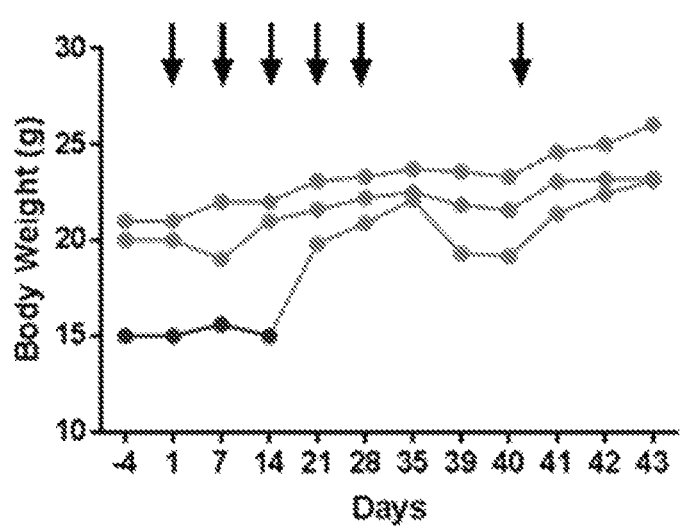
Figure 16C:
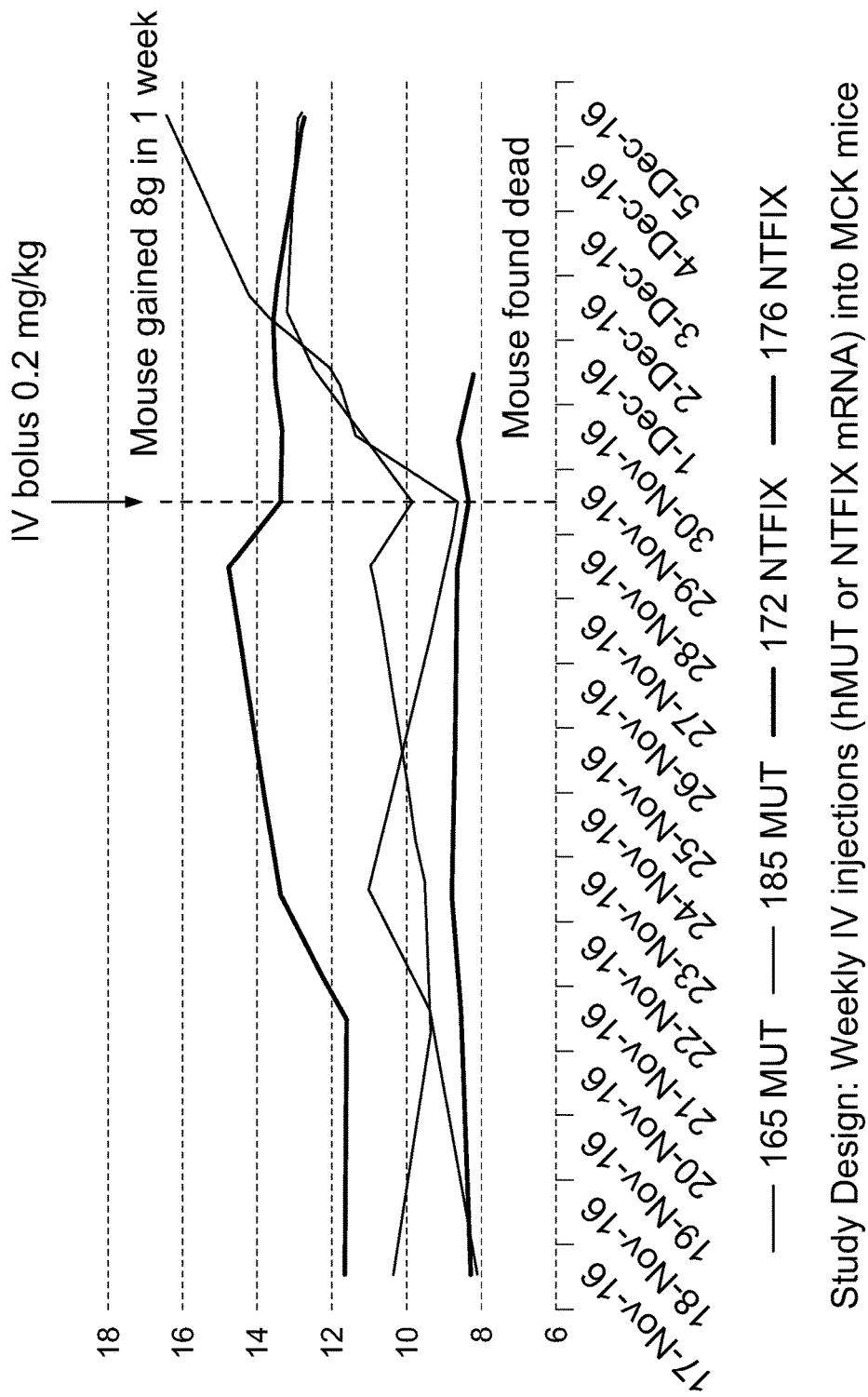

Although expression of MCM in skeletal muscle rescues MCK mice from neonatal lethality, these mice display severe metabolic perturbations and growth retardation that resembles clinical characteristics observed in methylmalonic acidemia patients. In the present example, repeat IV dosing of Compound 18 LNP-encapsulated hMCM mRNA (fully modified with mo5U) was investigated to determine whether mRNA therapy can correct biochemical and growth abnormalities. MCK mice were administered weekly IV injections of 0.16 mg/kg hMCM mRNA (encoding SEQ ID NO: 734) or a vehicle control (non-translating factor IX, NTFIX) mRNA. MCK mice that received hMCM mRNA injections showed decreased plasma MMA levels 3 and 6 days following each dose throughout the entire treatment period (FIG. 16A). Importantly, treated MCK mice also showed increased weight gain which was correlated to decreased plasma MMA levels (FIG. 16B). In contrast, MCK mice that received vehicle mRNA control (NTFIX) showed neither reduction in plasma MMA levels nor increase in body weight following 2 doses (FIG. 16A). Indeed, after 2 IV doses of NTFIX injections, one of the MCK mice died likely due to metabolic decompensation although the cause of death is unknown. To present further loss of MCK mouse, the vehicle control (NTFIX) mRNA treated mouse was switched to hMCM mRNA therapy. Interestingly, once that MCK mouse started to receive hMCM mRNA treatment, plasma MMA levels of this mouse quickly decreased from 835 µM to 153 µM within 3 days (FIG. 16A). Moreover, this mouse gained 4.8 g in body weight in just one week following crossover to hMCM mRNA therapy. After the fifth IV dose, the MCK mice were given a 10 day washout period (FIG. 16B). Interestingly, there was a partial rebound of plasma MMA to 955+/−SD µM in these mice 10 days following their last hMCM mRNA injection (FIG. 16A). Moreover, during this washout period, decreased body weight was observed in these mice (0.13+/− SD to 2.8+/−SD g) from day 6 to day 10 (FIG. 16B). When MCK mice were re-dosed with 0.2 mg/kg IV hMCM mRNA (encoding SEQ ID NO: 734) after the 10 day washout, plasma MMA levels decreased to 226+/−µM and body weight increased from 1.38+/−g to 3.81+/−g in 4 days. These data demonstrates that LNP-formulated hMCM mRNA is efficacious in lowering plasma MMA levels and simultaneously increasing body weight in this methylmalonic acidemia mouse model of the more severe Mut0 subtype.

Figure 17:
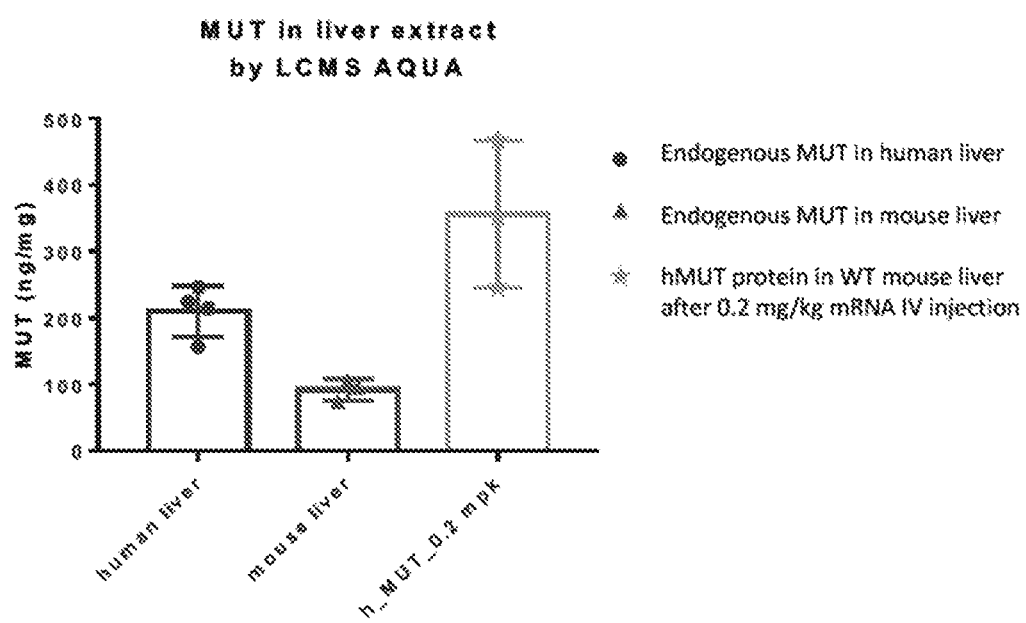
FIG. 17 shows MCM expression in liver of wild-type CD1 mice dosed with codon optimized MCM mRNA (SEQ ID NO: 734) formulated in lipid nanoparticles at 0.2 mg/kg compared to endogenous human MCM and endogenous mouse MCM.

Example 21. Expression of MCM in Liver of Wild-type Mice Dosed with Codon Optimized MCM Human mRNA Compared to Endogenous MCM in Normal Mouse and Human Liver To assess MCM expression in vivo, codon optimized MCM human mRNA (SEQ ID NO: 734) was introduced into wild-type CD1 mice. CD1 mice were injected intravenously with a single dose of codon optimized MCM mRNA (SEQ ID NO: 734) at 0.2 mg/kg. The mRNA was formulated in lipid nanoparticles (Compound 18) for delivery into the mice via tail vein injection (N=3). Mice were sacrificed 24 hours after dosing, and MCM protein levels in liver lysates were determined by LC-MS/MS. As shown in FIG. 17, dosing at 0.2 mg/kg in wild-type mice resulted in abundant expression of human MCM, higher than endogenous MCM found in human and normal mouse livers.

Figure 18A:
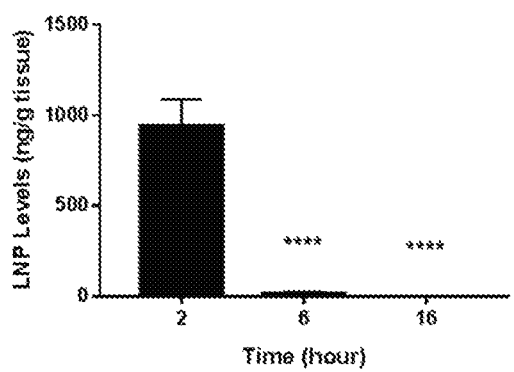
FIGS. 18A-C show a time course of the effects of injection of codon optimized MCM mRNA.
Figure 18B:
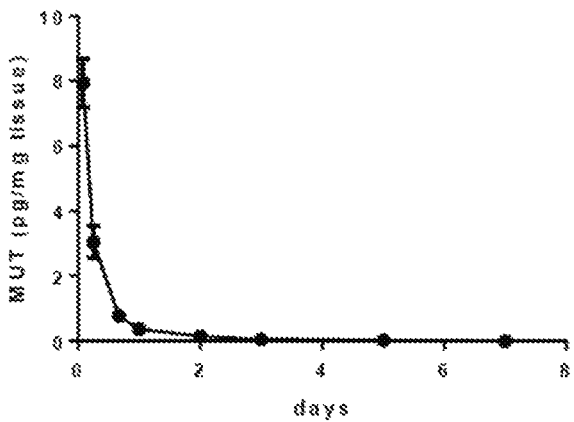
Figure 18C:
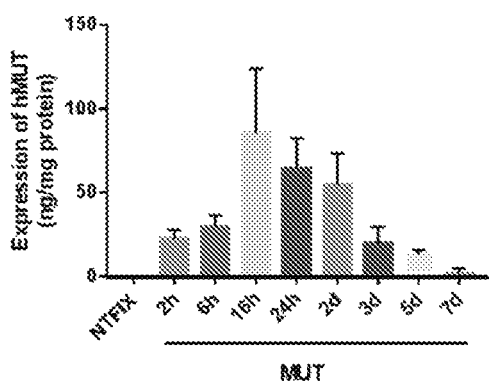

Example 22. MCM Expression in Liver of Mice Administered Codon Optimized MCM mRNA LNP encapsulates hMUT mRNA and distributes the mRNA to the liver, where it is subsequently translated to its functional protein. The half-life of the mRNA and protein product are critical determinants of the pharmacokinetics of mRNA-based therapeutics. To understand the kinetics of hMUT mRNA, the LNP, and the encoded MUT protein, we performed a PK study in wild type CD1 mice in which mice were administered a single IV bolus of 0.5 mg/kg hMUT mRNA or vehicle control (NTFIX) mRNA. Our data showed that 2 hours after administration, 939 ng/g LNP was detected in livers and by 6 hours, LNP concentrations decreased by almost 98.5% (FIG. 18A). At 16 hours, LNP concentrations are not detectable in the liver suggesting that the LNP is highly degradable and is rapidly cleared in liver. hMUT mRNA was also cleared quickly as shown in FIG. 18B, with a precipitous drop of hMut mRNA levels at 6 hours following a single IV hMUT mRNA administration (FIG. 18B). Over 98% Mut mRNA was cleared 48 hours after administration. In contrast, human MUT protein is rapidly expressed and showed a significantly longer half-life (FIG. 18C). Human MUT protein is detectable 2 hours and peaks at 16 hours after hMUT IV mRNA administration (FIG. 18C). Our data suggested that the half-life if expressed human Mut is approximately 1.6 days. The data show a decline in mRNA levels in the liver with levels reaching baseline by about 2 days. The sustained expression of MCM protein out to 5 days following a single administration of MCM-encoding mRNA demonstrates potential advantages in treating MMA patients with weekly dosing being a potentially acceptable dosing regimen to achieve therapeutically effective doses in humans.

Example 23. Lipid Nanoparticle Quantification and Kidney, Liver and Spleen Analysis In vivo analysis of lipid nanoparticles quantification, in situ hybridization for kidney, and bDNA for spleen is assessed. Codon optimized MCM mRNA (SEQ ID NO: 735) is administered to CD1 mice. CD1 mice are injected intravenously with either control mRNA (NT-FIX) or codon optimized MCM mRNA at 0.5 mg/kg. The mRNA was formulated in lipid nanoparticles (Compound 18) for delivery into the mice via tail vein injection. Mice (N=3/time point) are sacrificed after 2, 6, 16, 24, 48, 72, 120, or 168 hours. Lipid nanoparticles are quantified at early time points (2, 6, and 16 hours). ISH of kidney and bDNA of liver and spleen are analyzed and compared to untreated CD1 mice.

Example 24. In Vivo Delivery of mRNA Encoding MCM

Figure 19A:
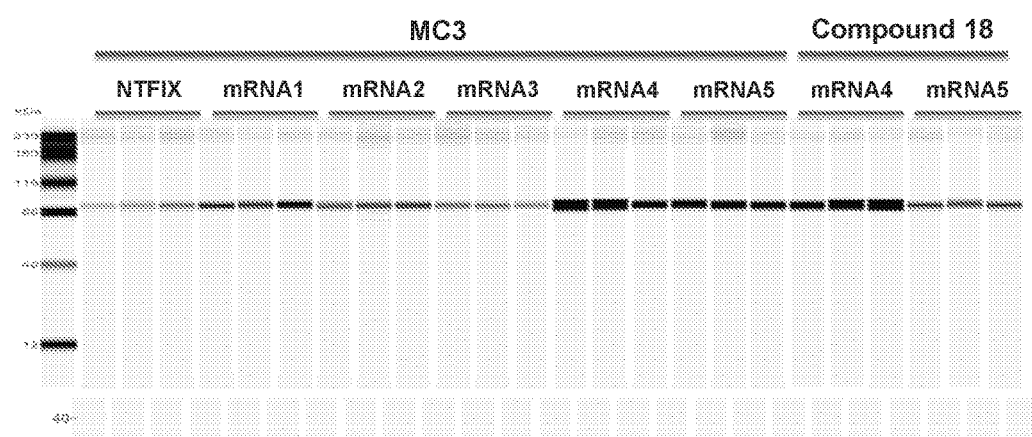
FIGS. 19A-B show MCM expression in livel of wild-type CD mice dosed with codon optimized MCM mRNAs, where the mRNA is formulated either with MC3 or Compound 18. NTFIX mRNA was used as a control.
Figure 19B:
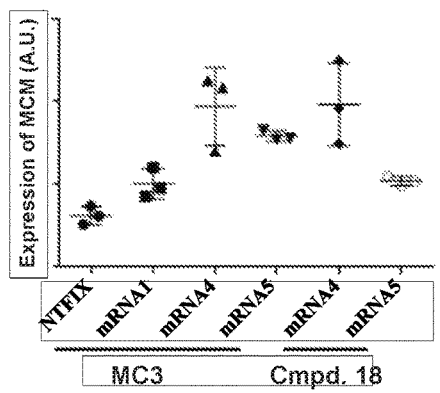

To assess methods of delivering MCM in vivo, codon optimized MCM human mRNA, i.e., mRNA1, mRNA2, mRNA3, mRNA4, and mRNA5 (SEQ ID NOs: 775, 776, 777, 734 and 778, respectively) or a vehicle control (non-translating factor IX, NTFIX) mRNA was introduced into wild-type CD1 mice. The mice were injected intravenously with a single dose of mRNA at 0.2 mg/kg. The mRNA was formulated for delivery into the mice via tail vein injection (N=3 per formulation). Compositions were formulated with either MC3 or Compound 18. Mice were sacrificed 24 hours after dosing, and MCM protein levels in liver lysates were determined by Western blot. FIG. 19A is a Western blot with equal loading of each lysate. FIG. 19B is a quantification of the expression patterns in the Western blot of FIG. 19A. As shown in FIGS. 19A and 19B, both MC3 formulations and Compound 18 formulations were effective in facilitating delivery and expression of mRNA encoding MCM. Delivering mRNAs encoding MCM in wild-type mice resulted in expression of human MCM at levels much higher than that of endogenous MCM in control mice.

Example 25. In Vivo MMA Level and Body Weight Effect on MCK Mice

Figure 20A:
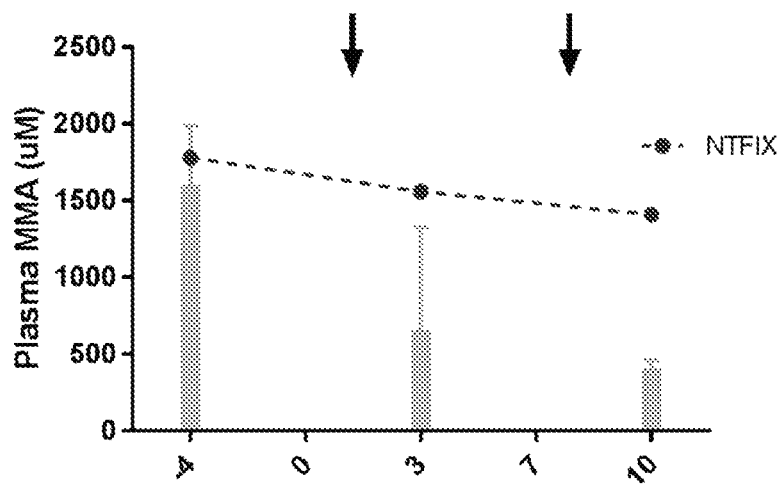
FIGS. 20A-B show the effects of administering codon optimized MCM mRNA to mice on the plasma levels of MMA (FIG. 20A) and the body weight of the mice (FIG. 20B).
Figure 20B:
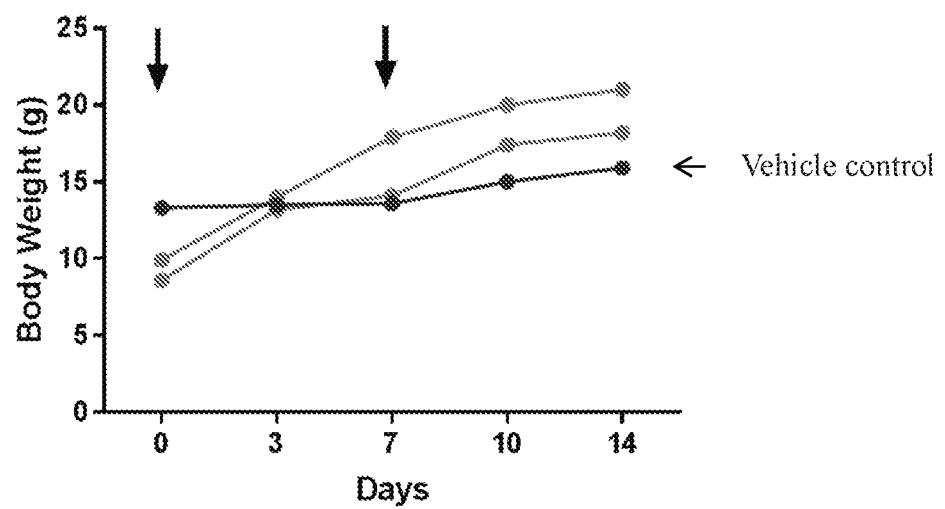

Two MCK mice were administered weekly IV injections of 0.2 mg/kg hMCM mRNA and the other two received a vehicle control (non-translating factor IX, NTFIX) mRNA at 0.2 mg/kg. The study encompasses 2 doses. The MCK mice that received hMCM mRNA injections showed decreased plasma MMA levels 3 days following each dose (FIG. 20A). Importantly, treated MCK mice also showed significantly increased body weight which was correlated to decreased plasma MMA levels. See FIG. 20B. In contrast, the MCK mouse that received vehicle mRNA control (NTFIX) showed no significant reduction in plasma MMA levels nor increase in body weight following 2 doses. One MCK mouse received the vehicle control died.

Certain exemplary mRNA sequences are shown below:

```
hMCM mRNA
                                                         (SEQ ID NO: 769)
TCAAGCTTTTGGACCCTCGTACAGAAGCTAATACGACTCACTATAGGGAAATAAGAGAGAAAAGAAGAGTAAGA

AGAAATATAAGAGCCACCATGCTGCGGGCCAAGAACCAGCTGTTCCTGCTGAGCCCTCACTACCTGCGGCAGGT

GAAGGAGAGCAGCGGCAGCCGGCTGATCCAGCAGCGGCTGCTGCACCAGCAGCAGCCCCTGCACCCCGAGTGGG

CCGCCCTGGCCAAGAAGCAGCTGAAGGGCAAGAACCCCGAGGACCTGATCTGGCACACGCCCGAGGGCATCAGC

ATCAAGCCCCTGTACAGCAAGCGGGACACCATGGACCTGCCCGAGGAGCTGCCCGGCGTGAAGCCCTTCACCCG

GGGCCCCTACCCCACCATGTACACCTTCCGGCCCTGGACCATCCGGCAGTACGCCGGCTTCAGCACCGTGGAGG

AGAGCAACAAGTTCTACAAGGACAACATCAAGGCCGGCCAGCAGGGCCTGAGCGTGGCCTTCGACCTGGCCACC
```

-continued

CACCGGGGCTACGACAGCGACAACCCACGGGTGCGGGCGACGTGGGCATGGCCGGCGTGGCCATCGACACCGT

GGAGGACACCAAGATCCTGTTCGACGGCATCCCTCTGGAGAAGATGAGCGTGAGCATGACCATGAACGGCGCCG

TGATCCCCGTGCTGGCCAACTTCATCGTGACCGGCGAGGAGCAGGGCGTGCCCAAGGAGAAGCTGACCGGCACC

ATCCAGAACGACATCCTGAAGGAGTTCATGGTGCGGAACACCTACATCTTCCCTCCCGAGCCCAGCATGAAGAT

CATCGCCGACATCTTCGAGTACACCGCCAAGCACATGCCCAAGTTCAACAGCATCAGCATCAGCGGCTACCACA

TGCAGGAGGCCGGCGCCGACGCCATCCTGGAGCTGGCCTACACCCTGGCCGACGGCCTGGAGTACAGCCGGACC

GGCCTGCAGGCCGGCCTGACCATCGACGAGTTCGCGCCCCGGCTGAGCTTCTTCTGGGGCATCGGCATGAACTT

CTACATGGAGATCGCCAAGATGCGGGCCGGCCGGCGGCTGTGGGCCCACCTGATCGAGAAGATGTTCCAGCCCA

AGAACAGCAAGAGCCTGCTGCTGCGGGCCCACTGCCAGACCAGCGGCTGGAGCCTGACCGAGCAGGACCCCTAC

AACAACATCGTGCGGACCGCCATCGAGGCCATGGCCGCCGTGTTCGGCGGCACCCAGAGCCTGCACACCAACAG

CTTCGACGAGGCCCTGGGCCTGCCCACCGTGAAGAGCGCCCGGATCGCCCGGAACACCCAGATCATCATCCAGG

AGGAGAGCGGCATCCCCAAGGTGGCCGACCCCTGGGCGGCAGCTACATGATGGAGTGCCTGACCAACGACGTG

TACGACGCCGCCCTGAAGCTGATCAACGAGATCGAGGAGATGGGCGGCATGGCCAAGGCCGTGGCCGAGGGCAT

CCCCAAGCTGCGGATCGAGGAGTGCGCCGCCCGGCGGCAGGCCCGGATCGACAGCGGCAGCGAGGTGATCGTGG

GCGTGAACAAGTACCAGCTGGAGAAGGAGGACGCCGTGGAGGTGCTGGCCATCGACAACACCAGCGTGCGGAAC

CGGCAGATCGAGAAGCTGAAGAAGATCAAGAGCAGCCGGGACCAGGCCCTGGCCGAGCGGTGCCTGGCCGCCCT

GACCGAGTGCGCCGCCAGCGGCGACGGCAACATCCTGGCCCTGGCCGTGGACGCCAGCCGGGCCCGGTGCACCG

TGGGCGAGATCACCGACGCCCTGAAGAAGGTGTTCGGCGAGCACAAGGCCAACGACCGGATGGTGAGCGGCGCC

TACCGGCAGGAGTTCGGCGAGAGCAAGGAGATCACCAGCGCCATCAAGCGGGTGCACAAGTTCATGGAGCGGGA

GGGCCGGCGGCCCCGGCTGCTGGTGGCCAAGATGGGCCAGGACGGCCACGACCGGGGCGCCAAGGTGATCGCCA

CCCGGCTTCGCCGACCTGGGCTTCGACGTGGACATCGGCCCACTGTTCCAGACGCCCCGGGAGGTGGCCCAGCAG

GCCGTGGACGCCGACGTGCACGCCGTGGGCGTGAGCACCCTGGCCGCCGGCCACAAGACCCTGGTGCCCGAGCT

GATCAAGGAGCTGAACAGCCTGGGCCGGCCCGACATCCTGGTGATGTGCGGCGGCGTGATCCCGCCCCAGGACT

ACGAGTTCCTGTTCGAGGTGGGCGTGAGCAACGTGTTCGGCCCCGGCACCCGGATCCCCAAGGCCGCCGTGCAG

GTGCTGGACGACATCGAGAAGTGCCTGGAGAAGAAGCAGCAGAGCGTGTGATAATAGTCCATAAAGTAGGAAAC

ACTACAGCTGGAGCCTCGGTGGCCATGCTTCTTGCCCCTTGGGCCTCCCCCAGCCCCTCCTCCCCTTCCTGCA

CCCGTACCCCCCGCATTATTACTCACGGTACGAGTGGTCTTTGAATAAAGTCTGAGTGGGCGGC hMCM mRNA (SEQ ID NO: 770)
TCAAGCTTTTGGACCCTCGTACAGAAGCTAATACGACTCACTATAGGGAAATAAGAGAGAAAAGAAGAGTAAGA

AGAAATATAAGAGCCACCATGCTGCGGGCCAAGAACCAGCTGTTCCTGCTGAGCCCCCACTACCTGCGGCAGGT

GAAGGAGAGCAGCGGCAGCCGGCTGATCCAGCAGCGCCTCCTCCACCAGCAGCAGCCCCTCCACCCCGAGTGGG

CCGCCCTCGCCAAGAAGCAGCTCAAGGGCAAGAACCCCGAGGACCTCATCTGGCACACCCCGAGGGCATCTCC

ATCAAGCCCCTCTACTCCAAGCGCGACACCATGGACCTCCCCGAGGAGCTCCCCGGCGTCAAGCCCTTCACCCG

CGGCCCCTACCCCACCATGTACACCTTCCGCCCCTGGACCATCCGCCAGTACGCCGGCTTCTCCACCGTCGAGG

AGTCCAACAAGTTCTACAAGGACAACATCAAGGCCGGCCAGCAGGGCCTCTCCGTCGCCTTCGACCTCGCCACC

CACCGCGGCTACGACTCCGACAACCCCCGCGTCCGCGGCGACGTCGGCATGGCCGGCGTCGCCATCGACACCGT

CGAGGACACCAAGATCCTCTTCGACGGCATCCCCCTCGAGAAGATGTCCGTCTCCATGACCATGAACGGCGCCG

TCATCCCCGTCCTCGCCAACTTCATCGTCACCGGCGAGGAGCAGGGCGTCCCCAAGGAGAAGCTCACCGGCACC

ATCCAGAACGACATCCTCAAGGAGTTCATGGTCCGCAACACCTACATCTTCCCCCCCGAGCCCTCCATGAAGAT

CATCGCCGACATCTTCGAGTACACCGCCAAGCACATGCCCAAGTTCAACTCCATCTCCATCTCCGGCTACCACA

TGCAGGAGGCCGGCGCCGACGCCATCCTCGAGCTCGCCTACACCCTCGCCGACGGCCTCGAGTACTCCCGCACC

-continued

GGCCTCCAGGCCGGCCTCACCATCGACGAGTTCGCCCCCCGCCTCTCCTTCTTCTGGGGCATCGGCATGAACTT
CTACATGGAGATCGCCAAGATGCGCGCCGGCCGCCGCCTCTGGGCCCACCTCATCGAGAAGATGTTCCAGCCCA
AGAACTCCAAGTCCCTCCTCCTCCGCGCCCACTGCCAGACCTCCGGCTGGTCCCTCACCGAGCAGGACCCCTAC
AACAACATCGTCCGCACCGCCATCGAGGCCATGGCCGCCGTCTTCGGCGGCACCCAGTCCCTCCACACCAACTC
CTTCGACGAGGCCCTCGGCCTCCCCACCGTCAAGTCCGCCCGCATCGCCCGCAACACCCAGATCATCATCCAGG
AGGAGTCCGGCATCCCCAAGGTCGCCGACCCCTGGGGCGGCTCCTACATGATGGAGTGCCTCACCAACGACGTC
TACGACGCCGCCCTCAAGCTCATCAACGAGATCGAGGAGATGGGCGGCATGGCCAAGGCCGTCGCCGAGGGCAT
CCCCAAGCTCCGCATCGAGGAGTGCGCCGCCCGCCGCCAGGCCCGCATCGACTCCGGCTCCGAGGTCATCGTCG
GCGTCAACAAGTACCAGCTCGAGAAGGAGGACGCCGTCGAGGTCCTCGCCATCGACAACACCTCCGTCCGCAAC
CGCCAGATCGAGAAGCTCAAGAAGATCAAGTCCTCCCGCGACCAGGCCCTCGCCGAGCGCTGCCTCGCCGCCCT
CACCGAGTGCGCCGCCTCCGGCGACGGCAACATCCTCGCCCTCGCCGTCGACGCCTCCCGCGCCCGCTGCACCG
TCGGCGAGATCACCGACGCCCTCAAGAAGGTCTTCGGCGAGCACAAGGCCAACGACCGCATGGTCTCCGGCGCC
TACCGCCAGGAGTTCGGCGAGTCCAAGGAGATCACCTCCGCCATCAAGGCGTCCACAAGTTCATGGAGCGCGA
GGGCCGCCGCCCCCGCCTCCTCGTCGCCAAGATGGGCCAGGACGGCCACGACCGCGGCGCCAAGGTCATCGCCA
CCGGCTTCGCCGACCTCGGCTTCGACGTCGACATCGGCCCCCTCTTCCAGACCCCCCGCGAGGTCGCCCAGCAG
GCCGTCGACGCCGACGTCCACGCCGTCGGCGTCTCCACCCTCGCCGCCGGCCACAAGACCCTCGTCCCCGAGCT
CATCAAGGAGCTCAACTCCCTCGGCCGCCCCGACATCCTCGTCATGTGCGGCGGCGTCATCCCCCCCCAGGACT
ACGAGTTCCTCTTCGAGGTCGGCGTCTCCAACGTCTTCGGCCCCGGCACCCGCATCCCCAAGGCCGCCGTCCAG
GTCCTCGACGACATCGAGAAGTGCCTCGAGAAGAAGCAGCAGTCCGTCTGATAATAGGCTGGAGCCTCGGTGGC
CATGCTTCTTGCCCCTTGGGCCTCCCCCAGCCCCTCCTCCCCTTCCTGCACCCGTACCCCCGCATTATTACT
CACGGTACGAGTGGTCTTTGAATAAAGTCTGAGTGGGCGGC hMCM ORF
(SEQ ID NO: 775)
ATGTTAAGAGCTAAGAATCAGCTTTTTTTACTTTCACCTCATTACCTGAGGCAGGTAAAAGAATCATCAGGCTC
CAGGCTCATACAGCAACGACTTCTACACCAGCAACAGCCCCTTCACCCAGAATGGGCTGCCCTGGCTAAAAAGC
AGCTGAAAGGCAAAAACCCAGAAGACCTAATATGGCACACCCCGGAAGGGATCTCTATAAAACCCTTGTATTCC
AAGAGAGATACTATGGACTTACCTGAAGAACTTCCAGGAGTGAAGCCATTCACACGTGGACCATATCCTACCAT
GTATACCTTTAGGCCCTGGACCATCCGCCAGTATGCTGGTTTTAGTACTGTGGAAGAAAGCAATAAGTTCTATA
AGGACAACATTAAGGCTGGTCAGCAGGGATTATCAGTTGCCTTTGATCTGGCGACACATCGTGGCTATGATTCA
GACAACCCTCGAGTTCGTGGTGATGTTGGAATGGCTGGAGTTGCTATTGACACTGTGGAAGATACCAAAATTCT
TTTTGATGGAATTCCTTTAGAAAAAATGTCAGTTTCCATGACTATGAATGGAGCAGTTATTCCAGTTCTTGCAA
ATTTTATAGTAACTGGAGAAGAACAAGGTGTACCTAAAGAGAAACTTACTGGTACCATCCAAAATGATATACTA
AAGGAATTTATGGTTCGAAATACATACATTTTTCCTCCAGAACCATCCATGAAAATTATTGCTGACATATTTGA
ATATACAGCAAAGCACATGCCAAAATTTAATTCAATTTCAATTAGTGGATACCATATGCAGGAAGCAGGGCTG
ATGCCATTCTGGAGCTGGCCTATACTTTAGCAGATGGATTGGAGTACTCTAGGACTGGACTCCAGGCTGGCCTG
ACAATTGATGAATTTGCACCAAGGTTGTCTTTCTTCTGGGGAATTGGAATGAATTTCTATATGGAAATAGCAAA
GATGAGAGCTGGTAGAAGACTCTGGGCTCACTTAATAGAGAAATGTTTCAGCCTAAAAACTCAAAATCTCTTC
TTCTAAGAGCACACTGTCAGACATCTGGATGGTCACTTACTGAGCAGGATCCCTACAATAATATTGTCCGTACT
GCAATAGAAGCAATGGCAGCAGTATTTGGAGGGACTCAGTCTTTGCACACAAATTCTTTTGATGAAGCTTTGGG
TTTGCCAACTGTGAAAAGTGCTCGAATTGCCAGGAACACACAAATCATCATTCAAGAAGAATCTGGGATTCCCA
AAGTGGCTGATCCTTGGGGAGGTTCTTACATGATGGAATGTCTCACAAATGATGTTTATGATGCTGCTTTAAAG

-continued

CTCATTAATGAAATTGAAGAAATGGGTGGAATGGCCAAAGCTGTAGCTGAGGGAATACCTAAACTTCGAATTGA

AGAATGTGCTGCCCGAAGACAAGCTAGAATAGATTCTGGTTCTGAAGTAATTGTTGGAGTAAATAAGTACCAGT

TGGAAAAAGAAGACGCTGTAGAAGTTCTGGCAATTGATAATACTTCAGTGCGAAACAGGCAGATTGAAAAACTT

AAGAAGATCAAATCCAGCAGGGATCAAGCTTTGGCTGAACGTTGCCTTGCTGCACTAACCGAATGTGCTGCTAG

CGGAGATGGAAATATCCTGGCTCTTGCAGTGGATGCATCTCGGGCAAGATGTACAGTGGGAGAAATCACAGATG

CCCTGAAAAAGGTATTTGGTGAACATAAAGCGAATGATCGAATGGTGAGTGGAGCATATCGCCAGGAATTTGGA

GAAAGTAAAGAGATAACATCTGCTATCAAGAGGGTTCATAAATTCATGGAACGTGAAGGTCGCAGACCTCGTCT

TCTTGTAGCAAAATGGGACAAGATGGCCATGACAGAGGAGCAAAAGTTATTGCTACAGGATTTGCTGATCTTG

GTTTTGATGTGGACATAGGCCCTCTTTTCCAGACTCCTCGTGAAGTGGCCCAGCAGGCTGTGGATGCGGATGTG

CATGCTGTGGGCGTAAGCACCCTCGCTGCTGGTCATAAAACCCTAGTTCCTGAACTCATCAAAGAACTTAACTC

CCTTGGACGGCCAGATATTCTTGTCATGTGTGGAGGGGTGATACCACCTCAGGATTATGAATTTCTGTTTGAAG

TTGGTGTTTCCAATGTATTTGGTCCTGGGACTCGAATTCCAAAGGCTGCCGTTCAGGTGCTTGATGATATTGAG

AAGTGTTTGGAAAAGAAGCAGCAATCTGTA hMCM ORF (SEQ ID NO: 776)
ATGCTGAGGGCCAAGAACCAGCTGTTTCTCCTGTCGCCCCACTACCTGAGGCAGGTGAAGGAGTCCTCCGGCAG

CAGGCTCATTCAGCAGAGGCTGTTGCACCAGCAGCAGCCCCTGCACCCAGAGTGGGCCGCCCTCGCCAAGAAGC

AGCTGAAGGGGAAGAACCCCGAGGACCTGATCTGGCATACGCCCGAGGGTATCTCCATAAAACCCCTCTACAGT

AAGAGGGACACCATGGACCTGCCCGAGGAACTGCCCGGCGTGAAGCCGTTCACGCGGGGCCCATACCCCACCAT

GTACACCTTCCGGCCGTGGACCATCAGGCAATACGCCGGCTTCAGCACCGTGGAGGAGAGCAACAAGTTCTACA

AGACAACATCAAAGCCGGTCAGCAAGGGCTGAGCGTAGCCTTCGACCTGGCCACCCACAGGGGCTACGACTCC

GACAACCCCAGGGTGCGCGGCGACGTGGGCATGGCCGGCGTGGCCATCGACACCGTGGAAGACACCAAGATCCT

CTTCGACGGCATCCCCCTGGAAAAGATGTCCGTGTCCATGACCATGAACGGGGCCGTTATACCGGTGCTGGCCA

ACTTCATAGTCACCGGCGAGGAGCAGGGGGTCCCGAAGGAGAAGTTAACCGGCACGATTCAGAACGACATCCTG

AAAGAGTTCATGGTGAGGAACACCTATATCTTCCCCCCCGAGCCCTCCATGAAAATCATCGCCGACATCTTCGA

GTACACCGCGAAGCACATGCCCAAGTTCAACTCCATCAGCATCTCCGGATATACATGCAGGAAGCCGGCGCCG

ACGCCATCCTGGAGCTGGCCTACACCCTGGCGGACGGACTGGAGTACAGCCGCACGGGCCTGCAGGCGGGCCTG

ACCATAGACGAATTTGCCCCGCGGCTGAGCTTTTTCTGGGGGATCGGCATGAATTTCTACATGGAGATCGCCAA

GATGCGGGCCGGCAGACGGCTGTGGGCCCATCTGATCGAAAAAATGTTCCAGCCCAAAAACAGCAAGTCCCTGC

TGCTGCGGGCCCACTGCCAGACCAGCGGCTGGAGCCTGACCGAGCAGGACCCGTACAATAACATCGTGAGGACC

GCCATCGAGGCCATGGCCGCCGTGTTCGGCGGGACGCAAAGCCTGCACACGAACTCCTTCGACGAGGCGCTCGG

CCTGCCCACCGTGAAGTCCGCTAGGATCGCCAGGAACACACAGATCATCATCCAGGAGGAGAGCGGCATCCCCA

AGGTGGCCGACCCCTGGGGCGGCTCCTACATGATGGAGTGCCTGACGAACGACGTGTACGACGCCGCCCTGAAG

CTGATCAACGAGATCGAGGAGATGGGCGGCATGGCCAAGGCCGTCGCCGAGGGCATCCCCAAGCTGCGCATCGA

GGAGTGCGCCGCCAGGCGCCAAGCCCGGATCGATAGCGGCAGCGAGGTGATCGTGGGGGTGAACAAGTACCAGC

TGGAGAAGGAGGACGCGGTCGAGGTCCTGGCCATAGACAACACGAGCGTGCGGAACAGGCAGATCGAGAAGCTC

AAGAAAATCAAGAGCAGCCGGGACCAGGCCCTGGCCGAAAGGTGCCTCGCCGCCCTCACGGAATGCGCCGCCAG

CGGCGACGGCAATATCCTGGCCCTGGCGGTCGATGCCAGCCGCGCTCGGTGCACCGTGGGGGAGATCACCGATG

CCCTCAAGAAAGTGTTCGGGGAGCACAAGGCCAACGACAGGATGGTGTCCGGCGCCTACAGGCAGGAGTTCGGC

GAAAGCAAGGAAATCACGAGCGCCATCAAGCGGGTCCATAAGTTCATGGAGAGGGAGGGCCGGAGGCCCAGGCT

GCTCGTGGCCAAAATGGGCCAGGACGGCCATGACAGGGGCGCCAAGGTGATCGCCACCGGGTTCGCCGACCTCG

GCTTCGACGTGGACATCGGGCCGCTGTTCCAGACGCCGCGGGAGGTCGCCCAGCAAGCGGTGGACGCCGACGTG

-continued

CACGCCGTCGGGGTGAGCACCCTCGCCGCTGGGCATAAGACCCTGGTGCCCGAGCTGATCAAAGAGCTCAACAG

CCTCGGCAGGCCCGACATTCTCGTTATGTGCGGCGGCGTCATCCCGCCCCAGGACTACGAGTTCCTGTTTGAGG

TCGGCGTCTCCAACGTGTTCGGCCCAGGCACCAGGATCCCCAAGGCCGCCGTGCAGGTGTTGGACGATATCGAG

AAATGCCTCGAGAAAAAGCAGCAGAGCGTC hMCM ORF (SEQ ID NO: 777)
ATGCTGCGGGCCAAGAACCAGCTGTTCCTGCTGAGCCCCCACTACCTGCGGCAGGTGAAGGAGAGCAGCGGCAG

CCGGCTGATCCAGCAGCGCCTCCTCCACCAGCAGCAGCCCCTCCACCCCGAGTGGGCCGCCCTCGCCAAGAAGC

AGCTCAAGGGCAAGAACCCCGAGGACCTCATCTGGCACACCCCGAGGGCATCTCCATCAAGCCCCTCTACTCC

AAGCGCGACACCATGGACCTCCCCGAGGAGCTCCCCGGCGTCAAGCCCTTCACCCGCGGCCCCTACCCCACCAT

GTACACCTTCCGCCCCTGGACCATCCGCCAGTACGCCGGCTTCTCCACCGTCGAGGAGTCCAACAAGTTCTACA

AGGACAACATCAAGGCCGGCCAGCAGGGCCTCTCCGTCGCCTTCGACCTCGCCACCCACCGCGGCTACGACTCC

GACAACCCCCGCGTCCGCGGCGACGTCGGCATGGCCGGCGTCGCCATCGACACCGTCGAGGACACCAAGATCCT

CTTCGACGGCATCCCCCTCGAGAAGATGTCCGTCTCCATGACCATGAACGGCGCCGTCATCCCCGTCCTCGCCA

ACTTCATCGTCACCGGCGAGGAGCAGGGCGTCCCCAAGGAGAAGCTCACCGGCACCATCCAGAACGACATCCTC

AAGGAGTTCATGGTCCGCAACACCTACATCTTCCCCCCCGAGCCCTCCATGAAGATCATCGCCGACATCTTCGA

GTACACCGCCAAGCACATGCCCAAGTTCAACTCCATCTCCATCTCCGGCTACCACATGCAGGAGGCCGGCGCCG

ACGCCATCCTCGAGCTCGCCTACACCCTCGCCGACGGCCTCGAGTACTCCCGCACCGGCCTCCAGGCCGGCCTC

ACCATCGACGAGTTCGCCCCCCGCCTCTCCTTCTTCTGGGGCATCGGCATGAACTTCTACATGGAGATCGCCAA

GATGCGCGCCGGCCGCCGCCTCTGGGCCCACCTCATCGAGAAGATGTTCCAGCCCAAGAACTCCAAGTCCCTCC

TCCTCCGCGCCCACTGCCAGACCTCCGGCTGGTCCCTCACCGAGCAGGACCCCTACAACAACATCGTCCGCACC

GCCATCGAGGCCATGGCCGCCGTCTTCGGCGGCACCCAGTCCCTCCACACCAACTCCTTCGACGAGGCCCTCGG

CCTCCCCACCGTCAAGTCCGCCCGCATCGCCCGCAACACCCAGATCATCATCCAGGAGGAGTCCGGCATCCCCA

AGGTCGCCGACCCCTGGGGCGGCTCCTACATGATGGAGTGCCTCACCAACGACGTCTACGACGCCGCCCTCAAG

CTCATCAACGAGATCGAGGAGATGGGCGGCATGGCCAAGGCCGTCGCCGAGGGCATCCCCAAGCTCCGCATCGA

GGAGTGCGCCGCCCGCCGCCAGGCCCGCATCGACTCCGGCTCCGAGGTCATCGTCGGCGTCAACAAGTACCAGC

TCGAGAAGGAGGACGCCGTCGAGGTCCTCGCCATCGACAACACCTCCGTCCGCAACCGCCAGATCGAGAAGCTC

AAGAAGATCAAGTCCTCCCGCGACCAGGCCCTCGCCGAGCGCTGCCTCGCCGCCCTCACCGAGTGCGCCGCCTC

CGGCGACGGCAACATCCTCGCCCTCGCCGTCGACGCCTCCGCGCCCGCTGCACCGTCGGCGAGATCACCGACG

CCCTCAAGAAGGTCTTCGGCGAGCACAAGGCCAACGACCGCATGGTCTCCGGCGCCTACCGCCAGGAGTTCGGC

GAGTCCAAGGAGATCACCTCCGCCATCAAGCGCGTCCACAAGTTCATGGAGCGCGAGGGCCGCCGCCCCCGCCT

CCTCGTCGCCAAGATGGGCCAGGACGGCCACGACCGCGGCGCCAAGGTCATCGCCACCGGCTTCGCCGACCTCG

GCTTCGACGTCGACATCGGCCCCCTCTTCCAGACCCCCCGCGAGGTCGCCCAGCAGGCCGTCGACGCCGACGTC

CACGCCGTCGGCGTCTCCACCCTCGCCGCCGGCCACAAGACCCTCGTCCCCGAGCTCATCAAGGAGCTCAACTC

CCTCGGCCGCCCCGACATCCTCGTCATGTGCGGCGGCGTCATCCCCCCCCAGGACTACGAGTTCCTCTTCGAGG

-continued

```
TCGGCGTCTCCAACGTCTTCGGCCCCGGCACCCGCATCCCCAAGGCCGCCGTCCAGGTCCTCGACGACATCGAG

AAGTGCCTCGAGAAGAAGCAGCAGTCCGTC
``` hMCM ORF (SEQ ID NO: 778)
```
ATGCTGCGGGCCAAGAACCAGCTGTTCCTGCTGAGCCCCACTACCTGCGGCAGGTGAAGGAGAGCAGCGGCAG

CCGGCTGATCCAGCAGCGCCTCCTCCACCAGCAGCAGCCCCTCCACCCCGAGTGGGCCGCCCTCGCCAAGAAGC

AGCTCAAGGGCAAGAACCCCGAGGACCTCATCTGGCACACCCCCGAGGGCATCTCCATCAAGCCCCTCTACTCC

AAGCGCGACACCATGGACCTCCCCGAGGAGCTCCCCGGCGTCAAGCCCTTCACCCGCGGCCCCTACCCCACCAT

GTACACCTTCCGCCCCTGGACCATCCGCCAGTACGCCGGCTTCTCCACCGTCGAGGAGTCCAACAAGTTCTACA

AGGACAACATCAAGGCCGGCCAGCAGGGCCTCTCCGTCGCCTTCGACCTCGCCACCCACCGCGGCTACGACTCC

GACAACCCCGCGTCCGCGGCGACGTCGGCATGGCCGGCGTCGCCATCGACACCGTCGAGGACACCAAGATCCT

CTTCGACGGCATCCCCCTCGAGAAGATGTCCGTCTCCATGACCATGAACGGCGCCGTCATCCCCGTCCTCGCCA

ACTTCATCGTCACCGGCGAGGAGCAGGGCGTCCCCAAGGAGAAGCTCACCGGCACCATCCAGAACGACATCCTC

AAGGAGTTCATGGTCCGCAACACCTACATCTTCCCCCCCGAGCCCTCCATGAAGATCATCGCCGACATCTTCGA

GTACACCGCCAAGCACATGCCCAAGTTCAACTCCATCTCCATCTCCGGCTACCACATGCAGGAGGCCGGCGCCG

ACGCCATCCTCGAGCTCGCCTACACCCTCGCCGACGGCCTCGAGTACTCCCGCACCGGCCTCCAGGCCGGCCTC

ACCATCGACGAGTTCGCCCCCCGCCTCTCCTTCTTCTGGGGCATCGGCATGAACTTCTACATGGAGATCGCCAA

GATGCGCGCCGGCCGCCGCCTCTGGGCCCACCTCATCGAGAAGATGTTCCAGCCCAAGAACTCCAAGTCCCTCC

TCCTCCGCGCCCACTGCCAGACCTCCGGCTGGTCCCTCACCGAGCAGGACCCCTACAACAACATCGTCCGCACC

GCCATCGAGGCCATGGCCGCCGTCTTCGGCGGCACCCAGTCCCTCCACACCAACTCCTTCGACGAGGCCCTCGG

CCTCCCCACCGTCAAGTCCGCCCGCATCGCCCGCAACACCCAGATCATCATCCAGGAGGAGTCCGGCATCCCCA

AGGTCGCCGACCCCTGGGGCGGCTCCTACATGATGGAGTGCCTCACCAACGACGTCTACGACGCCGCCCTCAAG

CTCATCAACGAGATCGAGGAGATGGGCGGCATGGCCAAGGCCGTCGCCGAGGGCATCCCCAAGCTCCGCATCGA

GGAGTGCGCCGCCCGCCGCCAGGCCCGCATCGACTCCGGCTCCGAGGTCATCGTCGGCGTCAACAAGTACCAGC

TCGAGAAGGAGGACGCCGTCGAGGTCCTCGCCATCGACAACACCTCCGTCCGCAACCGCCAGATCGAGAAGCTC

AAGAAGATCAAGTCCTCCCGCGACCAGGCCCTCGCCGAGCGCTGCCTCGCCGCCCTCACCGAGTGCGCCGCCTC

CGGCGACGGCAACATCCTCGCCCTCGCCGTCGACGCCTCCCGCGCCCGCTGCACCGTCGGCGAGATCACCGACG

CCCTCAAGAAGGTCTTCGGCGAGCACAAGGCCAACGACCGCATGGTCTCCGGCGCCTACCGCCAGGAGTTCGGC

GAGTCCAAGGAGATCACCTCCGCCATCAAGCGCGTCCACAAGTTCATGGAGCGCGAGGGCCGCCGCCCCCGCCT

CCTCGTCGCCAAGATGGGCCAGGACGGCCACGACCGCGGCGCCAAGGTCATCGCCACCGGCTTCGCCGACCTCG

GCTTCGACGTCGACATCGGCCCCCTCTTCCAGACCCCCCGCGAGGTCGCCCAGCAGGCCGTCGACGCCGACGTC

CACGCCGTCGGCGTCTCCACCCTCGCCGCCGGCCACAAGACCCTCGTCCCCGAGCTCATCAAGGAGCTCAACTC

CCTCGGCCGCCCCGACATCCTCGTCATGTGCGGCGGCGTCATCCCCCCCCAGGACTACGAGTTCCTCTTCGAGG

TCGGCGTCTCCAACGTCTTCGGCCCCGGCACCCGCATCCCCAAGGCCGCCGTCCAGGTCCTCGACGACATCGAG

AAGTGCCTCGAGAAGAAGCAGCAGTCCGTC
```

Other Embodiments

It is to be understood that the words that have been used are words of description rather than limitation, and that changes can be made within the purview of the appended claims without departing from the true scope and spirit of the disclosure in its broader aspects.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the disclosure.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (775 sequences)

SEQ ID NO: 1 - DNA, 2250 bp, Artificial Sequence
  Codon optimized sequence that encodes an MCM polypeptide with the I671V mutation
atgcttagggcaaaaaaccaattattcctgctgtcgcctcactatctgcgtcaagttaaagagagcagcgggtcccggttaattcagcagcggctactgcatcaacagcagcctctgcatccagagtgggcagccctggccaaaaagcagctgaaggggaagaatcctgaggacttgatatggcacacacctgagggaatcagtatcaaacctctgtattcaaaaagggacactatggacctgcccgaggaactgccaggagtcaagccgtttacacgcgggccctatccaacaatgtatactttcagaccgtggactattcggcagtatgcaggatttagtactgtcgaagagtccaataagttctataaggacaatatcaaggccggccagcaggggctgtctgtagccttcgatctagctactcacaggggctacgattctgacaatccccgggtcaggggagacgtcggtatggcgggagtggcgattgatactgtggaagatactaagattttgtttgatggaatcccactggaaaagatgagtgtttcaatgacgatgaatggtgccgtcataccagtactcgcgaacttcattgttacgggggaggaacaaggtgtgcccaaggagaagctcaccgggacaatacaaaatgatattttgaaggagttcatggtccgcaacacttacatctttccgcccgaaccaagcatgaaaataattgccgacattttcgagtatacagctaaacacatgcctaagttcaacagcatttctattagcggctatcacatgcaggaggcgggcgcagatgcaatactagagttagcatacaccctcgcagatggactggaatattcccgcacgggtctccaggccgggttaacaatcgacgagtttgccccacggctatcttttttttggggtattggcatgaatttctacatggaaattgcgaagatgcgagcaggaagaagactctgggctcacctgatcgaaaaaatgttccaaccgaagaattcaaagtctttactgctgagagcccattgtcagacatccggatggagcttgaccgagcaagatccttacaacaatatcgtgaggaccgcgatagaggcaatggctgccgtcttcggtggcacacagagcctgcacacaaatagctttgatgaggccctcggtctgcccacagtgaaaagtgctagaatcgcgcgaaatactcagattataatacaggaggaatcaggaatccctaaagtcgcagatccgtggggtggaagctacatgatggaatgtctgacaaatgacgtatatgatgcagccctgaagctgataaacgagatagaggagatgggcgggatggcaaaggccgtagccgagggaatccccaagctgaggatcgaagagtgtgcagccaggagacaggcacgaatcgattcaggctctgaggtcatagtaggggttaacaaataccagctcgaaaaggaggatgcggtggaggttcttgctatcgacaatacatccgtccgcaacaggcaaatcgagaaactgaagaagatcaagtctagcagggatcaggccctagccgaaagatgtctggctgcactcacagagtgcgctgccagtggagatggcaatatacttgctctcgccgtggacgcaagtcgggcccggtgcacggtgggcgagatcaccgatgcgcttaaaaaggtgtttggtgaacataaagccaatgacagaatggtgagcggcgcataccggcaggaatttggcgagtctaaagagataacctcagcaatcaagcgggtacataagttcatggagagagagggccggcgcccccgtcttctggtcgccaagatgggccaggatggacacgaccgcggcgctaaggtaattgccaccggtttcgcagatctcggtttcgatgtggatatcggtcctctgtttcaaaccccccgggaggtcgctcaacaagccgttgatgccgacgtgcatgcagtcggcgtgtctaccctggccgcggggcataaaacactcgtgccagagctcataaaggagctgaatagcttaggtagacctgatatacttgttatgtgcggaggggttatccctccgcaggactacgagtttctgttcgaggtgggggtgtccaatgtgttcggacctggaacacgcattcccaaagccgccgtgcaggttctcgacgacattgaaaagtgcctggaaaaaaagcagcagtcagtt

SEQ ID NO: 2 - DNA, 2250 bp, Artificial Sequence
  Codon optimized sequence that encodes an MCM polypeptide with the I671V mutation
atgctccgggccaagaatcaactgtttttactatccccccactatttgaggcaggtgaaagagagttccggcagcaggctgatacagcaacggcttctgcaccagcagcaaccactccacccagagtgggctgcactagcaaagaagcagctgaagggaaagaatcctgaggatctgatttggcatacccctgaggggattagcatcaagcccttatacagtaagagagacacgatggacctccccgaagaacttcctggcgttaaaccttttaccagagggccttaccctactatgtatacttttcgaccctggactatcagacagtatgccggtttctccactgtcgaggagagtaataaattctataaagacaacatcaaagccgggcaacagggcctgtctgtcgcatttgacttggccacacataggggctatgattctgataacccaagagtgcgcggggatgtgggtatggctggtgtggctatcgacaccgtggaagatactaaaattctctttgacggaatcccactggaaaaaatgagcgtcagtatgacaatgaacggcgccgtcattcctgttctcgctaactttattgtcaccggagaagagcaaggcgtaccaaaagagaagttgaccgggaccatccagaacgacattttgaaagaatttatggtgaggaatacatatatttttcctcccgaaccttcgatgaaaataatcgccgacattttcgagtatactgctaagcacatgcctaaatttaattctatatcaatttccggatatcacatgcaagaagctggggcagatgccatcttggaactcgcatataccttggcggatggcttggagtatagcaggacaggcctccaggctggactcacaatcgacgagtttgccccacggctgagttttttttggggcattggcatgaatttctacatggaaatcgcgaagatgagggctggccgccggctgtgggcgcatctgatagaaaaaatgttccagccaaagaattccaagtctctgctgctgcgcgcacactgtcagacgtctgggtggagtcttacagagcaagatccctacaacaacatcgttcgaactgccatcgaggccatggcagctgtgttcggagggacacagagcctgcacacaaacagcttcgatgaagctctgggcctgccaaccgtcaaatccgcaagaatagcacgaaacacacaaattataatacaggaagaaagtggaatcccaaaggtagcagatccttggggcggcagttacatgatggagtgtctcacaaacgacgtctacgacgctgctctgaaactcatcaacgagatagaagaaatggggggaatggcgaaagctgtagctgaggggatcccgaagctgcgcatagaagaatgcgccgctaggcgacaggctagaatcgattccggttctgaagtgatcgtcggcgttaataaatatcagctagagaaagaggatgcagtggaggtcctggccattgataataccagtgtgcgcaaccggcagattgagaagctgaaaaagatcaaatccagtagagatcaagctttggccgaaaggtgtctggctgccttgaccgaatgtgccgcaagcggagatggaaatattctggctttagcggtggacgcgagtcgggcccgttgtaccgtgggggagataaccgatgcgctgaagaaagtgtttggagaacataaggccaacgaccggatggtgtctggcgcctaccgccaggaatttggcgagtcgaaagaaattacctctgctattaaacgcgtacacaaattcatggaacgggaagggcggagaccgcgccttctggtcgccaagatgggccaagacgggcacgataggggtgcaaaggtgattgctactggcttcgctgatttgggctttgatgtggacatcggaccgctgttccagacgccgcgagaggtcgcccaacaggccgtcgacgctgacgttcacgctgtaggggtgagcaccctggccgccggtcacaaaacactggtgcctgaactgattaaagagctgaattcccttgggcgccctgacattcttgtaatgtgcggcggtgtcatacccccacaggactacgaatttctgttcgaggtgggtgtgtctaacgtgttcggcccgggcacaagaattccgaaggccgccgtgcaggttctggacgacattgagaaatgcctggaaaagaagcaacagagcgtt

SEQ ID NO: 3 - DNA, 2250 bp, Artificial Sequence
  Codon optimized sequence that encodes an MCM polypeptide with the I671V mutation
atgttacgggcaaagaaccaattgttccttctcagcccccactatctgcgacaggtgaaagagtcatccggatcccggctgatccagcagcggctgcttcaccagcagcagccactacatccggaatgggctgcgctagctaaaaaacagctaaaaggaaaaaatcccgaggatctaatttggcatactcccgagggcatcagtatcaaacctttgtactccaagagagacaccatggatctaccagaggagttaccaggcgttaagcctttcactaggggaccatatcccactatgtacaccttcagaccgtggaccatccgacagtatgccggatttagcaccgtggaggagagcaacaagttttacaaggacaatattaaggcggggcagcagggactttctgtcgccttcgatttggcgactcacagggggtatgacagcgacaatcctagggtgcgcggcgatgtggggatggccggcgtggccatcgataccgttgaagacactaagatcctgttcgacggtattcctctcgagaagatgagcgtaagcatgaccatgaatggcgccgtgattcctgtcttggccaacttcattgttacaggagaggaacaaggggtgcctaaagaaaaactgaccgggactatccagaatgatatccttaaggagttcatggtgcgcaacacttatatcttcccgccggagccgtctatgaaaattatagctgatatcttcgaatacacggccaagcacatgcccaaatttaacagcatctcaatatctggatatcacatgcaagaggccggagctgacgcgattttagagttagcttacacattggcagacgggttggagtatagcagaaccgggttgcaggcaggcctcaccatcgacgagttcgctcctaggctttcctttttttggggaattggtatgaatttctatatggagatcgccaaaatgcgagccggccgtaggctttgggcacacctcattgaaaagatgttccagccaaaaaactccaaatcgctcctcttgagggcacactgccagacatccgggtggtctctgactgaacaggatccctacaataacatcgtccggactgcaatcgaggcaatggccgcagtcttcggagggacccaatccctccacacaaactcctttgatgaagctctgggcctcccgacagtgaagtccgcccgcatcgcgcggaacacccaaattataattcaggaagagtccggcattccaaaggtggccgacccctggggcggctcttacatgatggagtgtctgacaaatgacgtttacgatgcagctctgaagcttatcaatgagatagaggagatggggggcatggcgaaggccgtggccgaaggaattcccaagctccgcatcgaggagtgtgctgcaagaaggcaggctaggatcgactccggctcagaagtgatcgtgggtgtgaacaaataccagctggagaaagaagacgccgtggaagtgctggctatcgataacacgtcagtgcgcaatcgacaaatagaaaagctgaagaagattaaatccagcagggaccaagcactcgctgagcggtgcctcgcagcgttgaccgagtgcgccgctagcggcgacggcaacatccttgcattagcagttgacgcctcacgagccaggtgtacagtgggggaaataaccgatgctctcaaaaaagttttcggtgaacacaaggctaatgaccgaatggtcagcggtgcataccggcaggaattcggagagtcaaaagagatcaccagtgccatcaagagggtacataaattcatggaaagggagggcaggcggccccgcctgttggtagccaagatgggacaggacgggcacgaccgaggagccaaggtgatagccacgggttttgccgatctgggttttgatgtggacatcggcccactgtttcagaccccccgtgaggttgcccagcaagctgtggacgccgatgtgcacgcggtgggagtttccaccctagcagccggtcataagacacttgttccggaactgatcaaagagctgaactccctcggacgtccagacattttggtcatgtgtgggggcgtgattcctccacaggactatgaatttctgttcgaggtcggagtcagtaacgtgttcgggccaggcacccgaatcccaaaggctgcagttcaggtactggacgatattgaaaaatgtctcgaaaaaaaacagcagtctgtg

SEQ ID NO: 4 - DNA, 2250 bp, Artificial Sequence
  Codon optimized sequence that encodes an MCM polypeptide with the I671V mutation
atgctgagggccaaaaatcagctcttcctgctttctcctcactacttgcggcaggttaaagaatctagcgggagtcgtttgattcagcagagacttctccaccagcagcagcctctccatccggagtgggcggcccttgccaagaagcagttgaagggcaagaatccggaggacttgatctggcacacgccggaggggatcagcatcaaaccgctgtactccaaaagggacactatggatctgcctgaggagctgccaggagtgaagcctttcacacgcgggccttatcctaccatgtacaccttccgtccgtggacaatccgccagtacgcaggtttctctactgtcgaggagagcaacaaattttacaaggacaatatcaaagcagggcaacagggcctgtctgtagctttcgacctggctacacatcgtgggtacgattccgataaccccagggtgcgaggagatgttggcatggctggcgtggccatcgatactgttgaagacacaaaaattctatttgacgggatacctcttgagaagatgagcgtgagcatgacgatgaatggagccgtcatccccgtcctggcgaattttatcgtgactggtgaagaacaaggagtaccaaaagaaaaactaactggcacaattcagaacgacattctcaaggaattcatggtgcgaaatacctacatcttccctccagaaccatccatgaaaatcatcgctgatattttcgagtacaccgcaaagcacatgcctaaatttaactctattagcattagtggatatcacatgcaggaagccggcgcagatgcgatccttgaattagcctacacactagctgatggcctcgagtactccagaacaggcctacaagcgggactgaccattgatgaatttgctccccgcctgagcttcttttggggcattgggatgaatttctatatggaaatcgccaagatgcgggctggccgtagattatgggcccaccttatcgaaaagatgttccagcccaagaactcgaaaagtttgctccttcgagctcactgtcagacctcaggctggtccctgaccgagcaggacccgtacaataacatcgtcagaaccgccatcgaggccatggccgctgtctttggaggcacccagtccttgcacaccaatagttttgacgaggccctgggtctgcccaccgtcaagagcgccagaattgcaagaaacacacagatcatcatccaggaagaaagcggtatcccgaaggtggcagacccctggggtggctcttacatgatggaatgcctcacgaatgacgtgtacgacgcagcgttaaaactcattaatgagatcgaagaaatggggggcatggcaaaggctgtcgcagaaggaatccctaagctgcgcatagaggaatgcgcggcccggaggcaggcacgcatcgactccggctccgaggtaattgtaggcgtgaataagtaccagctggagaaagaagatgctgttgaagttctcgctatagacaataccagcgttcggaacaggcagattgagaagctaaagaaaatcaagtcatcccgtgaccaggccctggccgaacggtgtctcgctgcactcaccgaatgtgccgcttcaggggatggcaatatcttggcgctggccgtagacgccagccgcgcaagatgtactgtcggtgagattacagacgcactcaagaaggtcttcggagagcacaaggccaatgatcgcatggtcagcggagcataccgtcaagagttcggagagagtaaggagattacatcagctatcaagcgggtccacaagtttatggaaagggagggaaggcgcccacgacttcttgtcgccaagatggggcaggacggccacgacagaggcgccaaagtcatcgctacgggcttcgcagatttgggatttgatgtcgatattggacctctctttcagacgccgcgcgaggtggctcagcaagccgtggatgcagacgtgcacgccgttggggtatccacgctcgccgcagggcacaagactctcgtacccgagttgattaaggagctgaatagtctcgggcggccagacatcctcgtgatgtgtggcggcgtaattcctccccaagattacgagtttctctttgaggtgggagtttccaatgtatttggaccgggcacccggattcctaaggcagccgtgcaagtcttggacgacattgaaaagtgtctagagaaaaaacagcaaagcgtg

SEQ ID NO: 5 - DNA, 2250 bp, Artificial Sequence
  Codon optimized sequence that encodes an MCM polypeptide with the I671V mutation
atgcttagagcgaaaaaccagctgttcctgcttagcccacactacctacggcaggtcaaggaaagttctggttcacgtctcatacagcagagactcttacaccagcagcagccactgcacccagagtgggcagccttggcgaagaagcagctgaaaggaaagaatcctgaagatcttatctggcacaccccagaaggcatctcaatcaagcctctgtactcaaagagagatactatggatttgcccgaagagctgcccggcgtcaagccttttactcgaggcccttatccgaccatgtacacctttcgtccgtggaccatccgtcagtacgctggattctctacagtcgaagaaagcaataagttctataaggacaacatcaaagccggccagcagggtctgtccgtggcgtttgacctggccactcatcggggctacgatagtgataacccccgggtcagaggggatgtcggaatggctggcgtagccattgacaccgtggaggacaccaaaattctatttgatggcatccccttggaaaagatgagtgtttccatgaccatgaatggagccgtcatccccgtgctggcaaattttattgtaacaggggaagagcagggagtgcctaaggagaagttaacgggtaccattcaaaacgatatattgaaagagtttatggttcgaaatacctatatcttcccccctgagccatctatgaaaatcatagcagacatatttgagtacactgcgaaacacatgcccaaattcaacagcatctctatcagcggctaccacatgcaagaggccggagctgatgctatcttggaactggcgtacaccctggcggacggtctggagtactcccgtaccggactccaggccggcctgaccatcgacgaatttgcccctaggttatcatttttttggggaattggcatgaacttttatatggagatcgcaaaaatgcgggccggaagaaggctttgggcccacctcattgaaaaaatgttccaaccgaagaacagtaaatctcttctcctgcgggctcactgccagacttctgggtggtcccttactgagcaagatccctacaataacatcgttagaacagcaatcgaagcaatggccgcagtttttggcggaacgcagtccctgcataccaatagcttcgatgaggcgctcggattaccaactgtgaaatccgcaagaatcgctcgcaatacccagatcatcattcaggaggagagtgggattcctaaggtggcagatccatggggcggctcgtacatgatggaatgccttaccaacgacgtgtacgatgctgctctgaagctcattaatgagatcgaagaaatggggggaatggccaaagcggtggcagagggcattccaaagctccgcatcgaggaatgtgctgcaaggaggcaggccaggatcgattccggaagcgaggtcattgttggggtgaataagtatcagctggaaaaggaggatgctgtggaagtgctggcaattgataacactagcgtgaggaaccgtcagatcgagaagctgaaaaagataaagagctcgcgagaccaagccttagcagagcggtgccttgcggcactaacagaatgtgctgccagtggggatggaaacattcttgcactggctgtcgacgccagtcgagcaaggtgtacagtgggagagatcacagacgctttgaaaaaagtgttcggagagcacaaggcgaacgaccgcatggtgtcaggagcctaccgccaggaattcggcgaaagtaaagagattacttcagccattaagagggtccacaagtttatggaacgtgagggcaggcggcccagattactcgtggccaagatgggtcaagacggccacgataggggtgcaaaagtgattgcaaccggcttcgcagaccttggatttgatgtggacattgggccactttttcagacccctagagaagtggcacagcaggcagttgatgccgatgtacatgccgtgggagttagtaccctcgcggctggccacaagacactagtacctgagcttattaaagagctgaatagcctcggtaggcctgatatccttgtgatgtgtggcggcgttatacctccacaggattacgagttccttttcgaggttggtgtttcaaacgtctttggtcctggcacgcgtatacctaaagcagcagtgcaagttttggatgacattgagaaatgtctggaaaagaaacaacagtcagtg

SEQ ID NO: 6 - DNA, 2250 bp, Artificial Sequence
  Codon optimized sequence that encodes an MCM polypeptide with the I671V mutation
atgctgcgcgctaagaatcagctgttcctgctctctcctcattatctccgccaggttaaagaaagctccgggtctagactcattcagcagaggttgctgcaccaacagcagcctctgcacccagaatgggctgcactggccaagaagcagcttaaagggaaaaacccggaagacctgatttggcatacccccgaggggattagcattaaaccattgtattccaaacgagatacgatggatctgcccgaggagctgcccggcgtgaagccttttacaaggggtccttatcccactatgtatacatttagaccctggaccattcgccagtacgccggatttagtacagtcgaggagagcaacaaattttacaaggacaacataaaagctgggcaacagggcctgagtgtcgcattcgacctcgccactcaccgaggatacgactccgataatccgcgggttcgcggtgatgtgggcatggcaggagtcgcaattgatacggtggaggacaccaaaatcctgttcgacggtatccccctggagaaaatgagcgtcagtatgacaatgaatggagccgtgattccagtcttggccaatttcattgtaacaggagaggaacagggcgtccctaaggagaaactaacagggaccattcagaacgacatacttaaggagtttatggtgcggaacacctatatctttcccccggagccttcaatgaagattatcgcggatatttttgaatacacagcaaagcatatgccaaaattcaatagcataagcatcagcggttatcacatgcaggaagctggggccgacgccatcctggagcttgcttatactctggcggatggcctcgagtactcgcgcactggattgcaggccggcttgacaattgacgagttcgcccccagacttagtttcttttggggaatcggtatgaacttttatatggaaattgccaagatgcgcgccggcaggcgcctgtgggcgcacctgattgaaaagatgtttcaacccaagaacagtaagtcactgctcttgcgggcccattgccagactagcggatggagcctgaccgagcaggatccgtacaacaacattgttcggactgccatcgaggccatggcggccgtgtttggggggacacagagcctccatacaaattccttcgacgaggctctcggactgccgacagtgaaatctgctcggattgcccgcaatacacaaatcataattcaggaggagtcaggtataccaaaggtggccgatccttggggaggcagctatatgatggagtgcctaaccaacgatgtgtacgacgcagctctgaagctcattaacgagatcgaggaaatgggcggtatggccaaggccgtggctgagggtattcccaaacttcgcatcgaagagtgtgccgcgaggcgccaggctcgaattgactccggaagtgaggtgatcgttggagtcaataagtaccagcttgagaaggaagacgctgttgaggtcttagccattgacaatacctcagttagaaatcgccagattgaaaaactgaaaaaaatcaagtcctcgcgcgaccaggctctcgctgagcgatgcctcgcggcactgacagagtgtgctgcctcgggcgacgggaatattctcgccttggccgtggacgcctcacgcgcgcgatgtaccgtcggggagattacagatgcattgaagaaagtgtttggagagcacaaagcgaatgaccgcatggtatccggagcttatcgtcaggagttcggtgagtcgaaagaaattacctcagccattaaaagagtgcataaattcatggaaagggaagggaggaggccccgcctacttgtggctaaaatggggcaggacggccacgacagaggcgctaaagtaatcgccacaggcttcgcagacttgggctttgacgtcgacatcggccctctcttccaaacccccagggaggtggcccagcaggccgttgatgctgacgtgcatgcagtcggagtatcaacattagccgccggccacaagacactcgtcccagaattaattaaagaactgaatagtctcgggcggccagacattttggtcatgtgcggaggggtgattccgcctcaggattatgagtttctattcgaagtcggagtgagtaatgtcttcggcccaggtaccaggatacccaaggctgcggtgcaggtcctcgatgacattgagaagtgcctggagaagaaacagcagagcgtc

SEQ ID NO: 7 - DNA, 2250 bp, Artificial Sequence
  Codon optimized sequence that encodes an MCM polypeptide with the I671V mutation
atgctacgcgccaagaatcagctctttctgctgtctccgcactacttgcgacaggttaaagagtcttcgggctcccggctgattcagcagcgcctgctacaccagcaacaacctctgcacccagaatgggctgctttggcaaaaaagcaattgaaaggtaaaaaccccgaggacctcatttggcatacccccgagggaattagtataaagccattgtacagtaagagagatacaatggatttaccagaggaactccccggggtgaaaccattcacaaggggtccatacccaaccatgtacaccttcagaccatggactatccggcagtacgctgggttctcaacagtggaagagtcaaacaagttttataaggacaatatcaaagctggccagcagggtttgtcagtggcttttgatctagccacgcaccgtggctatgatagcgacaacccaagggtgcgaggggatgtcggcatggccggcgtcgccatagatacagtggaagacaccaaaatcctgtttgacggaatacctttggagaaaatgagcgtcagcatgaccatgaatggggctgtcattcctgtgttggccaactttatcgtcaccggtgaggagcagggcgttccaaaagagaagcttaccggaactattcagaacgatatcctgaaagagtttatggtgcgtaacacctacatttttccccccgagccatctatgaagatcatcgcggacatattcgaatatacggcaaagcatatgcctaagtttaacagcatctcgatcagcggctatcatatgcaggaagcaggggccgatgccatcctcgagctcgcttataccctggccgacggtctggaatattcccgtacaggcctacaagccggtttgaccatcgatgagttcgcacccagattatcttttttttgggggattggaatgaatttttacatggaaatagcaaagatgcgggctggacgtaggctgtgggctcaccttattgagaaaatgtttcagccgaagaactcaaaatcgctcttgctgagagctcattgccagacttccgggtggtctctgactgaacaggacccttataacaatatcgtccgtactgctattgaggcaatggccgcagtgtttggcggtacccagtcattgcatacaaactcattcgacgaagctctgggactcccaacggtaaaatcagcacgcattgctaggaacacacagatcatcattcaggaagaatccggaattccaaaggtggccgatccttggggaggctcttatatgatggagtgcctgacgaacgatgtgtatgatgccgccctcaagcttattaacgaaatcgaggaaatggggggcatggccaaagctgtagcggagggtatacctaagttgcgcattgaagaatgcgccgctcgtagacaggccagaattgattctggctcggaagtgattgtgggcgtaaacaaataccagctcgagaaggaggacgccgttgaggttttggcaatcgacaatactagcgtgcgcaaccgccagatagaaaagctgaaaaagatcaagtctagcagagaccaagctcttgccgagcgctgtctggctgcactcactgagtgtgccgcaagtggggacggaaacattctggccctagctgtagacgcttcccgcgcgaggtgtacggtcggcgaaatcacagatgccctgaaaaaagtgttcggggaacataaggcaaatgataggatggtgtcgggggcctaccgtcaagaatttggagaatccaaggagattaccagcgccataaaaagggtgcataagttcatggagagagaggggagacgccctaggctgctcgttgctaaaatgggacaggacggccacgatcgaggcgccaaggtgattgccaccggtttcgctgacttaggattcgatgtggacattggtccgttgttccagacgccacgcgaggtggcacagcaagccgtggacgccgatgtgcatgccgtgggcgtgtcgactttggcagcagggcacaagaccctggttcccgagcttatcaaggagctaaatagccttggccggcccgacatcctggtcatgtgcgggggagttattcccccccaggactacgagtttctattcgaggtgggagtaagtaatgtgtttggaccgggtacgaggatccccaaggccgccgtccaggttcttgacgacatagaaaaatgtttggaaaaaaagcagcagagcgtg

SEQ ID NO: 8 - DNA, 2250 bp, Artificial Sequence
  Codon optimized sequence that encodes an MCM polypeptide with the I671V mutation
atgctgcgggcaaaaaatcagctgtttttgctttccccacactatctccgacaggtcaaagagagcagcggaagtaggctcatccagcagaggctgctacaccaacagcagcctttgcaccctgaatgggctgccctggcgaaaaagcaactgaagggcaaaaaccccgaggacctgatctggcatactcccgaaggcatatcgataaagcccctgtattcaaagcgagacaccatggatctccccgaagaacttcctggcgtgaaacctttcacccggggcccctaccctactatgtatacattccgcccatggaccatccggcagtatgcaggctttagcactgtggaggagtctaataagttttacaaagacaacataaaggcgggacagcaaggactctctgtcgcattcgacctggccacccatcgcgggtacgatagcgataatccaagagtgagaggggacgtcggaatggccggtgtggcaatcgataccgtagaggataccaaaatccttttcgacgggatacctctcgaaaaaatgtcagtgtccatgacgatgaatggcgctgtgataccagtgctggccaacttcatagtgaccggcgaggaacagggtgtccccaaggagaagctgactgggaccatccagaatgacattctcaaggagttcatggtaagaaatacctacatattccctcctgaacctagtatgaaaataattgccgatattttcgagtatactgctaagcatatgccgaagtttaattctattagcatttctggctaccatatgcaggaggctggagccgacgctatcttagaacttgcatacaccctggccgacggactcgaatatagtaggacagggttgcaggctggcttaactattgacgagttcgcacctagattgtcatttttttggggtataggcatgaatttctatatggaaattgccaagatgcgggcagggcgcagattatgggcccacctgattgagaagatgtttcagccaaaaaatagcaagagcctgttgttgagagctcactgccagaccagcggttggtctctcaccgagcaggacccctacaacaatatcgtgcggactgcaatcgaggccatggccgctgtgttcggtggcacacagagcctacacactaacagttttgatgaggcacttggtctccccacggtgaaatcagcccgaatcgcccgtaatacccagatcatcatccaagaggaatccggaatcccaaaggtcgcagatccctggggaggctcttatatgatggagtgtttgacgaacgacgtttacgatgctgcactcaagttaattaacgagatcgaggagatgggaggtatggctaaagccgtagctgaggggattccaaaattgaggattgaagagtgtgccgcccgacggcaggcaaggattgattccgggagcgaggtcatcgtgggcgtcaataaatatcagctggagaaagaagacgcagttgaagtacttgccattgataacaccagtgtgaggaaccggcaaattgaaaaattgaaaaagatcaagtcttcacgagaccaagccctggcggagcgatgcctggctgccctgacggaatgtgccgcatctggagacggcaatatactggcgcttgccgtggatgcatcacgggccaggtgtaccgtaggcgagattactgatgcccttaaaaaggtgttcggggagcacaaggctaacgaccggatggtgtctggcgcgtataggcaggaattcggcgagtccaaggagataacttccgctataaagagggtccataaatttatggagagagaggggagacgcccaaggttacttgtggcaaagatgggacaggatggacatgatagaggggcaaaggttatcgccacggggtttgctgacctggggttcgatgtggatatcggccccctcttccagaccccaagagaggtggcccagcaggccgtcgacgccgacgtacacgccgttggcgtgtccacgctggcggccggccacaagacactagtgcctgagcttatcaaagaattaaacagtctcgggagacctgacattcttgtgatgtgcggaggggttattccaccgcaggattacgaattcctgttcgaagttggcgttagcaatgtcttcgggcccggcaccagaattcctaaagctgccgtgcaggtccttgatgacatcgaaaaatgtctggagaagaaacagcaaagcgtg

SEQ ID NO: 9 - DNA, 2250 bp, Artificial Sequence
  Codon optimized sequence that encodes an MCM polypeptide with the I671V mutation
atgcttagagccaagaatcagttgttcctcctgagccctcactatctccgccaggttaaagagagcagtggctcacggctgatccaacagcgcctgctgcaccagcagcaacccctccaccccgaatgggcagccctcgctaaaaaacagcttaaagggaagaatcctgaagacctgatctggcacacccctgaaggcattagtataaaaccactgtattccaagcgcgacactatggacctgccagaggagctgccaggagtgaaaccttttacaagagggccgtaccccaccatgtatacttttcggccctggaccatccgccagtacgctggattcagtacagtcgaagagtctaataagttctataaagacaacataaaggctggccagcaaggactctctgtagcattcgaccttgcgactcaccgaggctatgatagcgataatcctcgcgtgaggggagatgttgggatggccggagtggcaatagataccgtcgaagacaccaaaatactcttcgatgggatccctcttgaaaaaatgtccgtgagcatgaccatgaatggtgccgttatcccggttctcgcgaactttattgtgaccggtgaagagcagggagtgcctaaggagaaactgactggcactatccagaacgacattctcaaagagttcatggtccgcaacacttacatcttcccacccgagccttccatgaaaataatcgctgacatattcgagtacactgctaaacatatgcccaagtttaactcgatcagcattagcggctaccatatgcaggaggctggcgccgacgccatcctcgagctcgcctatactttggccgacggcctggaatactcgaggacagggcttcaggccggcttaacaatcgatgaatttgccccgcgcttgagcttcttttggggaattgggatgaatttctacatggaaatcgcaaaaatgcgtgccggtagacggctatgggctcacctcattgagaagatgtttcagcctaagaacagcaagagcctgctgctgagagcccactgtcaaacgtcgggctggtcgcttacagagcaggatccctacaacaacattgtgcgaaccgccattgaggcaatggccgccgtattcggaggcacgcaatccctgcataccaactcttttgacgaggcgctgggtctgcccactgtgaaatcggccaggattgctcgcaacacacaaatcatcatccaagaagagtccgggattcccaaggttgccgatccatgggggggcagctacatgatggagtgccttactaacgatgtttatgatgctgcacttaaactgatcaacgaaatagaagagatgggggggatggcaaaggccgtcgccgaagggatacccaagctgaggatcgaggaatgcgcggctcgacggcaggcccggatcgactccggaagcgaggtcatcgtcggcgtaaataaataccaactggaaaaggaggacgcggttgaggtgttggccatagacaacacctcagtacgaaaccgacagatcgagaaattaaaaaagatcaaatcaagccgcgatcaggcactggctgagcggtgcctggccgcactgactgagtgtgcagcctcaggagacggtaacatcctcgctctggccgtggatgcaagtcgggcccgctgtacggtgggggagatcactgacgctctgaaaaaagtttttggagaacacaaggcaaacgataggatggttagcggcgcataccggcaggagttcggtgaatctaaagagattacctctgcaatcaagcgggttcacaagttcatggagcgagaaggcaggcggccacggttgttagtggctaaaatggggcaggatggtcacgacagaggggctaaggtgattgccaccggattcgccgacctagggttcgacgtggatattgggcctttgttccagacaccacgggaggtggctcaacaagccgtggacgcggatgtgcacgccgtgggggtgtccacccttgccgcaggccacaaaaccctggtgccagaactgattaaggagctcaattcattgggcagacctgacattctggtgatgtgcgggggcgtaattcctccccaggactacgagtttctgttcgaagtgggcgtgagtaacgtgttcggacccggtaccagaatccccaaggccgccgtccaggtgctggacgacatcgagaaatgtctggaaaagaagcaacagtctgta

SEQ ID NO: 10 - DNA, 2250 bp, Artificial Sequence
  Codon optimized sequence that encodes an MCM polypeptide with the I671V mutation
atgctgcgggctaagaatcaactgttcttgttgagcccccactatctgaggcaagtgaaagagagtagtggaagccggctcatccaacaaagacttctgcaccagcaacaacctctgcatccggagtgggcggcgctggcaaagaaacaattgaagggtaaaaatccagaggacctgatttggcacaccccagaggggatttcgatcaaacctctgtacagcaagagggacactatggacttgcctgaggagctgccaggagtcaagccattcacaaggggaccatatcctacaatgtacacttttaggccctggacaattagacaatacgccggtttttcaactgtcgaggaaagcaataaattctacaaggacaacatcaaagctgggcagcaaggtctttcagtggctttcgacctggcgactcacaggggttacgactctgataaccctcgagtgcgaggggatgtcggaatggccggggtggccatagatacagtggaggacaccaagattctattcgacgggataccgctcgagaagatgtcagtttctatgacaatgaacggtgcggtcattccggtcttggcaaactttattgttacaggtgaggaacagggggttccaaaggaaaaactgaccggaactatacaaaatgacatcttgaaggaattcatggtgcgcaacacctacattttcccgccagaaccaagcatgaaaattatcgccgacatattcgagtatactgctaaacacatgcctaaattcaacagcattagcatcagcggctatcacatgcaagaggccggtgcggacgccattcttgaactggcatacaccctcgccgatgggctggagtactcccgaactgggctccaggccggactaacaatcgacgagttcgccccgcgtctctctttcttctggggaatcggaatgaacttctacatggagattgcaaaaatgagagcggggcgcagactatgggcacaccttatagaaaaaatgttccagcccaaaaattctaaaagcctgctactgagagctcattgtcaaacttctggctggagtttgaccgaacaagatccatataataatattgtccggacagcgattgaggctatggccgccgtctttggcggtactcagagccttcacacaaattcttttgatgaagcactggggctgccgacagttaagagtgccaggatagccaggaacacacagattattattcaggaggagtccggcatacccaaggtggctgatccctggggcgggagctacatgatggagtgccttacgaacgatgtctatgacgccgctctgaagctgattaacgagatcgaggagatgggtggtatggccaaagctgtagccgaggggattcctaagctgagaatcgaggagtgcgcagctcggagacaggctcgcatcgactctgggtccgaagtcatagttggggtgaacaagtatcagcttgaaaaggaggatgccgtggaggtgctggccatagataatacgtcggtgagaaatagacagattgagaaattaaaaaaaattaagagtagcagggatcaagccctcgctgagcggtgcctcgcagctctcaccgaatgtgccgcaagcggcgacggtaacatcctcgctttagcagtcgacgccagcagggcccgctgtactgtgggagagatcaccgatgccctgaaaaaggtcttcggggaacataaagccaatgatcgcatggtaagcggggcttatagacaagaattcggtgagagcaaggagatcacgtccgcaatcaaaagggtccataaattcatggagagagagggtagacgcccaagactcctcgtggcaaaaatggggcaggatggacatgaccggggtgccaaagtgatcgccaccggattcgcagatctgggcttcgatgtcgacattggcccgctctttcagacacctcgtgaagtggcgcagcaggccgtcgacgctgatgtgcacgctgttggggtgagcactctcgcagccggtcacaaaaccctggtgccggaactaatcaaagaactcaactctctcgggcgtccagacatcctcgtgatgtgtggcggtgtcatcccaccccaggattacgagtttttatttgaagtgggtgtctctaatgtgttcggccccggaacacgcattcccaaagctgcagtccaggtcctagatgacatcgaaaagtgccttgagaagaagcaacagagcgtc

SEQ ID NO: 11 - DNA, 2250 bp, Artificial Sequence
  Codon optimized sequence that encodes an MCM polypeptide with the I671V mutation
atgttaagggcaaagaaccagcttttcctcctgagccctcattacctacggcaggtgaaggagagctccggaagccgcctcattcagcaacgcctcctgcatcagcagcagccccttcaccccgaatgggcggccctggctaagaagcaattgaagggtaagaacccagaggacctgatttggcatactcccgagggcatttctatcaaacccctgtacagcaagcgcgacaccatggacctaccagaagagttgccaggcgtcaaaccctttactcggggcccttatcctaccatgtacaccttccgtccctggacaatccggcagtatgctggatttagtacagtcgaggagagcaataaattttataaggacaatataaaagcaggtcagcagggcttgtccgttgcctttgacctagcgacacataggggatatgattccgacaatccccgggtgaggggtgatgtcggcatggctggagttgctattgacaccgtggaagacactaagatcctattcgatggaatccccctggagaaaatgtccgtgagcatgaccatgaacggcgctgtgattcccgtcttagcaaactttattgtgacaggcgaggagcagggcgtgccaaaagagaaattgactggtaccattcagaacgacatactgaaggagttcatggtgcggaatacatatatatttcccccagaaccgtctatgaaaatcattgcggacatcttcgagtacaccgcgaagcacatgcccaaatttaatagcatcagtatcagcgggtatcacatgcaggaggccggcgcagacgcgatccttgaactcgcgtataccttggctgatggactcgaatattcaaggaccgggttgcaagcagggctgaccatcgacgagtttgcacctcgactgagctttttctgggggatcgggatgaacttttatatggagatcgccaagatgcgtgcggggcgacgcttatgggcgcatcttattgaaaaaatgtttcaacctaaaaacagcaagtcgctgctcctccgggcgcactgccagactagcgggtggagcctgaccgaacaagatccctacaataacatagttaggaccgcaatagaagccatggcagcggtgtttggcgggacgcagagtctccacaccaacagcttcgatgaggccctgggacttcccacagtgaagtctgccaggatcgcccgcaacacccagattatcatacaagaagagtctggaatcccaaaggtggccgatccctggggagggtcttatatgatggagtgtctgactaacgacgtgtacgacgcggccctgaaactaatcaatgagatcgaggagatggggggcatggctaaagcagtggccgaagggataccgaagctaagaattgaggaatgtgctgcaaggagacaggcgcgaatcgattccggctccgaggtgatcgtgggtgtcaataagtatcagctggagaaggaggatgctgtcgaggtcctggcgatcgataacacatcagtcaggaatagacagattgagaaacttaaaaagattaagagctcccgggatcaggctcttgccgagcgctgccttgctgctcttacagaatgtgcagcaagtggggacggtaacatactggcgctggcggtcgatgcctcaagggcaagatgtaccgtcggtgagatcaccgacgcgctgaagaaagttttcggcgaacacaaggccaacgaccgaatggttagcggtgcttatagacaggaattcggcgagtccaaggaaataacatccgctatcaagagagttcataaattcatggagcgagaggggcgtagaccccgcctcctggtcgctaagatggggcaggacggtcacgacagaggggcaaaggtcattgccacaggatttgcagacttagggtttgacgtcgacataggacctttatttcaaaccccaagagaggtggctcagcaagcagtggacgccgatgttcatgccgtaggagtgagtaccctggcagccggccacaagaccctagtgccagaactgattaaagaactcaacagtttaggaaggccagatatcctggtgatgtgcggcggcgtaatccctccacaagactatgaattccttttcgaagttggcgtttccaatgtatttggccctggcacaagaatacccaaggccgcagtgcaggtgctcgacgacatcgaaaaatgcctggagaagaagcagcaatcagtt

SEQ ID NO: 12 - DNA, 2250 bp, Artificial Sequence
  Codon optimized sequence that encodes an MCM polypeptide with the I671V mutation
atgctgcgcgcaaaaaaccagttatttctgctttctccccattacctgagacaggtgaaagaatcaagcggctctcgactgatccagcaacggctcttacatcagcagcagccgttgcatcctgagtgggcagcactggccaaaaagcagctgaagggcaaaaatcccgaggacctaatctggcatacccccgagggaatcagtattaagcctctttattctaaacgggacaccatggacctcccagaagaactgcctggagtaaaacctttcacccgaggcccttatcctacaatgtacacgtttagaccatggaccatcagacagtacgctgggttctcaacagtggaggaatccaataagttctataaagacaacatcaaagcaggccaacagggactgagcgttgcctttgatctggcaacccaccgcggttacgatagcgacaaccccagggtaagaggcgacgtcggaatggcaggggtagcgatagacactgttgaggacaccaaaattctgttcgatggtatccctctggaaaagatgagcgtgtccatgactatgaatggagcagtgatccctgtgctggcaaactttatcgttaccggcgaggagcagggcgtgccaaaggaaaaactgacggggactattcaaaacgatatcttaaaggagtttatggtgcgcaacacgtatatatttccaccagaacctagcatgaaaatcatcgctgatatattcgagtacacagcaaaacatatgcccaaatttaactccattagcatatccggataccacatgcaggaagccggagcggacgcaatcctcgagctagcgtatactctcgcggacgggctcgagtatagcagaactgggttgcaagctggcctgaccatcgatgaatttgcacccagactctcttttttttgggggataggcatgaatttttatatggaaatcgcaaaaatgagagccggccggagattgtgggcccacttgatcgagaagatgttccagccaaaaaacagcaaatcactgttgcttcgagctcattgtcagacatcgggatggtctctgaccgaacaggatccctacaacaacattgtgagaaccgccatcgaggccatggctgcagtcttcggaggaacacaaagtctccatactaactcattcgatgaggctctgggactgccaactgtaaaatctgccagaattgctagaaacacccagattattattcaggaggagtccggtatacctaaggttgcagatccgtgggggggcagttacatgatggagtgtctgaccaacgacgtgtatgatgccgcactgaagctcattaatgagatcgaggagatgggtggcatggccaaagctgtggcggaaggaatccccaaactgcgaattgaggaatgcgcagctagacgtcaggcacggatcgacagcggatccgaggtgattgtgggggttaacaaatatcagctcgaaaaggaggatgcagttgaagtgctcgcaatcgataatacgtcggtgcgcaataggcagattgagaagctcaaaaagattaagagctcaagggatcaggctctggctgaaagatgtctcgctgccctgacagagtgcgcagcaagtggagacggcaacatccttgcgttggcagtcgatgcttcaagagctcgctgtaccgtcggggagatcacagacgctctaaagaaagtttttggggaacacaaggctaacgatcgaatggtgtccggtgcatatcgccaagaatttggtgagagcaaggagatcaccagcgcgattaagcgggtccataaatttatggagagagaggggcgtagaccgcggttactggttgctaagatggggcaagacggccacgatagaggcgccaaagtgatcgccaccgggttcgcagacctcggatttgacgttgacattggtccactttttcagaccccacgcgaggtggcacagcaggcagtcgacgccgacgtacacgcagtgggcgtatcaactctggctgctgggcacaaaacccttgtgccggagctcatcaaagagctgaactcgctcgggcgccccgatattctcgttatgtgtgggggggtcattcctccccaggactacgagttcctcttcgaggtcggggtatcaaatgtgtttggacccggaacacgaatacccaaggcagccgttcaggtgctggatgatattgagaagtgcttagaaaagaaacagcagtcagtg

SEQ ID NO: 13 - DNA, 2250 bp, Artificial Sequence
  Codon optimized sequence that encodes an MCM polypeptide with the I671V mutation
atgctcagggcaaagaaccagttatttctgttgtcaccccattacctcaggcaggtgaaggaatctagcgggagccgcctgatacagcagcgtcttttgcaccagcaacagcctttacatccagagtgggcagctctggcgaagaaacaacttaaggggaagaatcccgaggacttgatttggcacactcccgaaggtattagcattaaaccgctatactccaaaagagatacaatggacctgcccgaagagcttcccggagtgaagccatttacacgcggcccatatccaaccatgtatacctttcgaccttggaccataagacaatatgccgggttttctaccgtggaggaatcaaacaaattctataaggataacatcaaggccgggcagcagggcctcagcgttgcctttgacctggccactcacagaggctatgattccgacaatccccgagtgagaggggatgttgggatggccggagtcgccatagatacagttgaagatacgaagattctcttcgatggaatccccctcgagaaaatgagtgtaagcatgaccatgaacggggcagtgatacccgtgctcgccaattttatcgtgactggcgaagaacaaggggtgcccaaagaaaagctcacaggcaccattcagaacgacatactgaaggagttcatggtgcgtaacacttacattttcccccccgaaccttcaatgaagattatagccgatatattcgaatacacagccaaacacatgcccaagttcaacagcattagtattagtgggtaccatatgcaagaagccggtgccgatgctatactggagcttgcgtacacactcgcagacgggctagagtatagccgtaccggcctccaggccggtctaactattgacgagttcgcaccccgtcttagttttttctggggaattggtatgaatttctatatggagatcgcaaagatgagagctggtcggagactctgggcccacttaattgagaaaatgtttcagcctaagaattccaagtccttgctgctccgggctcattgtcaaactagcggttggtctttaactgagcaagacccctataataacattgttcgcactgctattgaggctatggcggcggtgttcggcgggactcagagcctgcacacaaacagctttgatgaagctcttggacttccaaccgtcaagtccgccagaatagcccgaaacactcagattatcatccaggaggagtcaggaattcctaaggtcgctgatccatggggcgggtcttacatgatggagtgcctcaccaatgacgtctacgatgccgccctcaaactgataaacgaaatagaggagatgggagggatggccaaggcagtagcggaaggtatcccaaagctccggatcgaggagtgtgcggcgcgccggcaagctcggatcgattccggaagcgaggtgatcgtcggggtgaacaagtatcagctagaaaaggaagatgctgtggaggttctcgcaatagataacacatcagtacgaaacagacagatcgagaaactgaagaagatcaaatcatcaagagatcaggccttggctgagagatgcttggctgcattgacagagtgcgccgcaagcggggatggcaatatccttgcattggctgtcgacgcttcccgtgccaggtgcacagtaggtgaaattaccgacgctttgaaaaaggtgttcggagagcacaaggccaatgatcgcatggtttccggcgcctaccgacaggagttcggcgaatcaaaagagatcacatccgcaatcaagagggtgcacaaatttatggaacgcgaggggagacggccgcgcctccttgttgcgaagatgggacaggatggacacgacaggggagctaaggtcatagccacggggttcgcagacctaggtttcgacgtggatatcggaccgctattccagacacctcgggaagtagctcaacaggccgttgacgccgacgtacacgccgtgggcgtctctaccctggcggctggtcataaaacactggtgcctgagttgatcaaggagctcaactccctggggcgtccagacatattagtgatgtgcgggggagtcattccaccacaggattatgagtttttatttgaggtgggcgtatctaatgtgtttggccccggtacacgcatcccaaaggcagccgtgcaggttctggacgacatcgagaagtgtctcgagaagaagcagcagtctgtg

SEQ ID NO: 14 - DNA, 2250 bp, Artificial Sequence
  Codon optimized sequence that encodes an MCM polypeptide with the I671V mutation
atgctgagagcgaaaaaccagctattcctgttatcaccacactacctgagacaggtaaaggagtcgtcagggagccggcttattcaacaacgactgctccatcaacagcagccactacacccagaatgggccgcactggctaaaaaacaactgaagggcaagaaccctgaggatctgatctggcacacgcctgaaggaatctcaatcaaacctctgtacagcaagcgcgacacaatggatctgccagaggagctgcctggagttaaacccttcaccaggggcccttacccaactatgtacacttttagaccttggacgattaggcagtatgctggattctcaacagttgaggagtcaaataaattttacaaggacaacatcaaggccggacagcagggactctctgtcgcctttgacctagccacacatagagggtacgactcagataatccccgggtccgtggcgacgttggaatggcaggagtggctattgataccgtggaggataccaagatactctttgacggcattcccctggagaagatgagcgtgtctatgacaatgaacggggcagtgatacccgtgctagcgaatttcattgtgacgggcgaggagcagggcgtgcctaaggaaaaattgaccggtactattcagaacgacattctgaaagagttcatggtgcgcaacacatatatctttcctccagaaccatccatgaaaataatcgccgacatattcgaatacactgccaagcacatgcccaaatttaactctatatctatttctggttaccatatgcaagaagctggagcagacgctatccttgaattggcctacaccctggccgatgggcttgagtactcccgaactggattgcaggcgggacttacaatcgacgaattcgccccccggctcagttttttctggggtataggaatgaatttctatatggagatcgcgaaaatgcgggctgggcggagactctgggcccacttgatcgagaagatgtttcagcccaagaacagcaaatccctgctcctgagggcccactgccagacaagcggctggagcctcacagagcaggatccctataataacattgtgaggaccgctattgaggccatggctgcggtctttggagggacccaatctttacacactaattcctttgacgaggccttagggctgcctacggttaagagtgctcgcattgctaggaacacccaaatcattattcaggaggagtcaggcatcccgaaggtggcagacccttggggggggtcatacatgatggagtgtctgacaaacgacgtttatgacgccgctctgaagctgattaatgagatagaagagatgggcgggatggcaaaggcagtcgcagaaggaattccaaaactgcgcattgaggaatgtgcagcccgcagacaagcccgaatagacagcggaagtgaagtcattgtaggagtgaataaataccaactggagaaagaggacgctgttgaggtgcttgctattgataacacaagcgtccgcaatcgacagatcgagaagcttaaaaaaattaagtcgagccgagatcaggccctggccgagcgctgccttgccgcgctgacggagtgcgccgcctcaggagacgggaatattcttgctctggcagtggacgctagccgcgcacgatgcacagtcggtgagattactgatgctctcaaaaaagtgttcggggagcacaaggctaatgataggatggtttccggagcctacagacaagagtttggtgagtcaaaggagatcacgagtgccattaaacgcgtccacaaatttatggagagagagggtcgccggccaaggctgctggtggctaagatgggacaggacggccacgataggggggctaaagtgatcgccacaggatttgccgaccttggctttgatgtcgacatcggaccactgttccagacaccaagggaggtcgcgcaacaggcagtagacgcagatgtccatgccgtcggggtcagcacgctggcggctggacataagactctggtccccgagcttatcaaagagctgaattcactcgggaggccagatatcctcgtgatgtgtggtggtgtaattcctccccaggattacgagtttttgttcgaggtgggggtctcaaatgttttcggccctggcacacgtatccccaaggccgcagtgcaggtcctcgatgatatagagaagtgcctggaaaagaagcagcaaagcgtc

SEQ ID NO: 15 - DNA, 2250 bp, Artificial Sequence
  Codon optimized sequence that encodes an MCM polypeptide with the I671V mutation
atgcttagagccaagaatcagttgttcctgttaagcccacattacctcagacaggtgaaggagagttccggctcacgcctcattcagcagcgtttactacaccagcagcagccgctccaccctgagtgggcagctttggccaagaaacagttgaagggtaaaaatcccgaagatctcatctggcacactcccgaaggaatctcaattaaacctctgtacagtaaaagagacacaatggaccttccggaggaactcccaggcgtcaagccatttaccaggggcccatatccaaccatgtataccttccgtccttggacaataagacagtacgccggctttagtactgtggaggaatctaataagttttacaaagataatatcaaagctggccagcaggggcttagtgttgcgttcgacctggccacccatcggggctacgactctgacaaccctcgggttcgcggcgatgtgggaatggcaggtgtcgccattgataccgttgaggataccaagattctgttcgacggcatccccttggaaaagatgagcgtaagtatgaccatgaatggtgctgtcattccagtgttggctaatttcattgtaaccggagaagagcagggagtgccaaaagagaagctgacaggcacaatacagaacgacattctgaaggagttcatggtgcggaatacctatatcttccccccggagcctagtatgaagatcatcgccgatatttttgagtatacagcaaaacacatgccaaaatttaactctatttctatttcaggataccatatgcaggaggccggagccgacgccattcttgagctggcttatactctggctgacggcttggagtactctaggactggcctgcaggccggcctcacaatcgacgaattcgcaccccgactgtcctttttttgggggattggcatgaatttttacatggagatcgcaaaaatgcgggcgggccgcagactgtgggcccacctgattgagaagatgtttcagcccaagaatagcaagtcacttcttctcagggctcattgtcagacttcaggttggtcgctgaccgagcaggatccctacaacaacattgtacgaactgccatcgaggccatggccgctgtgtttggaggcacccagtcactgcatacaaatagttttgatgaggctctggggctccccaccgtgaaaagcgctcgaatagcccggaacacgcaaatcatcatccaggaggaatccggaatacctaaagttgccgacccatggggtgggagctacatgatggaatgtctaaccaacgatgtgtacgatgcagcattgaagcttataaatgagatcgaagaaatggggggaatggcaaaagcagtggccgaaggcattcctaaacttcgcatcgaagagtgcgctgcacggaggcaggcccgaatcgattccggtagcgaggtgattgtgggagtgaataaatatcaactggaaaaggaagatgccgtggaggtgctggctattgataacacctcagtaagaaacaggcagattgaaaaattgaaaaagataaagtcatcgcgcgatcaagccctggccgaacggtgtctcgcggccctgactgagtgcgccgccagtggtgatggaaacatcttggcactggctgtcgatgctagccgggcccgctgcaccgtgggagaaatcactgacgccctgaagaaggttttcggcgaacataaggcaaatgacagaatggtttcaggggcctataggcaggaatttggcgaatccaaagaaattactagcgccatcaagcgagtgcacaagttcatggagcgggaaggtcgtcgcccgcgcctgcttgtcgcaaaaatgggccaggacgggcatgacagaggggctaaagtcatcgccactggatttgcggatctcggtttcgacgtggatattggacctctgttccagacaccacgggaggtggcccagcaggcggtggatgcagatgtgcacgcagtcggggtctcgacactcgccgcaggacacaaaaccttagtccctgagctgattaaagaacttaactcattaggccgccctgatatcctggttatgtgcggaggcgtgatccctccacaggattatgaatttttattcgaagttggggtgtctaatgtttttggccccgggacacggatcccaaaggccgcggtgcaggtcctggatgatatcgagaaatgtttggagaagaagcagcaaagtgtg

SEQ ID NO: 16 - DNA, 2250 bp, Artificial Sequence
  Codon optimized sequence that encodes an MCM polypeptide with the I671V mutation
atgctgagagcgaaaaaccagctttttcttttgtcacctcattacctgaggcaggtcaaagagagttcgggttccagactgatacagcagcgccttcttcatcagcagcagcccctacatccagagtgggcagctctcgctaagaaacagctgaagggcaagaaccccgaagatctcatctggcacactcctgagggcatttctattaagcccctgtactctaaacgagacactatggatctccccgaggaattgccaggcgtgaaaccattcacaaggggcccataccccaccatgtatactttccggccatggacaatccggcagtacgccggcttctcgaccgtggaagaatccaataaattttataaggataacataaaggcggggcagcagggactatccgtggccttcgatctagctactcacagaggctacgacagcgacaacccaagagttagaggggatgttggcatggccggggtggcaatcgacaccgtggaggatacgaagatcctcttcgatggaatccccctggagaagatgagtgtgtcgatgaccatgaatggcgccgtgatccccgttctggctaatttcatagtgacgggcgaagaacagggggtgccaaaggaaaaactgactggaaccattcagaacgacattttaaaggagttcatggtgaggaatacttacatctttccaccagagcctagtatgaaaataatagctgacatttttgagtacaccgctaagcatatgcctaagtttaattcaatctctatttcaggttatcacatgcaagaggcgggtgcagatgcaatcctagagctggcctatacactggctgacggactggagtactctcgcacgggacttcaggccggactcactatcgacgaatttgctcctcggctgagttttttctgggggatcgggatgaatttttacatggagatcgcgaaaatgcgtgctggcaggcgcctgtgggcgcacttgattgagaaaatgtttcagcccaaaaattccaagtccctgctgctgagggctcattgccaaactagcggatggtctcttaccgagcaagatccctacaacaatattgtgagaacagctattgaggccatggctgcagtgtttggagggacacagagtctccacaccaactcatttgatgaagcccttggattacccactgtgaagtctgccaggatcgcaaggaatactcagataatcattcaggaggagagcggcatcccaaaggtagctgacccctgggggggctcctacatgatggagtgtttgaccaacgatgtgtacgacgccgcgctcaaactcattaatgaaattgaggaaatgggtgggatggctaaagccgtggccgagggcattcctaagctcagaatagaagaatgcgccgccagaaggcaggcgcgcattgatagtggttcagaggttattgtgggagtaaataagtaccagctggagaaggaagacgccgttgaagttctggccatcgataacacaagtgtgcgcaacagacagatcgaaaaacttaaaaagattaagtcgagtcgggaccaggcattggcagagagatgtttagccgcacttaccgaatgtgccgcttcaggcgacgggaacatcctcgctctggccgtagatgcatcccgtgcgcgctgcactgtcggcgaaatcaccgacgccctgaagaaagtgtttggggagcacaaggcaaatgatcggatggtttctggggcttacaggcaggaattcggagaaagtaaggagatcacctccgccataaagcgtgtccacaagttcatggaacgggaaggccgccgaccaagactactcgttgccaagatgggccaggacggacatgacagaggtgccaaggtgatagcaacagggtttgccgacctgggattcgacgtggatatcggacccctctttcaaaccccacgggaagttgcccaacaggccgtcgatgctgacgtgcacgctgttggagtgtctactcttgctgccgggcacaagacccttgtgcccgagctgattaaggagttgaactcccttggacggcctgacatcctggtgatgtgcgggggcgtgatccctcctcaggactatgaattcctgtttgaggtgggggtatcaaacgtttttggtccgggcactaggatcccaaaggccgcagtacaggtattggacgacatagagaagtgcctcgaaaagaaacaacaatcagta

SEQ ID NO: 17 - DNA, 2250 bp, Artificial Sequence
  Codon optimized sequence that encodes an MCM polypeptide with the I671V mutation
atgttgcgcgccaaaaatcagctttttttactatcacctcactacctgagacaggtgaaagagtcctccgggagccggctcattcaacaaaggctactacatcaacaacagcccctccaccctgaatgggcagctctcgcaaagaaacagctcaagggtaaaaatcctgaggacttaatctggcatacacctgaaggtatttctataaagcccctgtattccaagcgcgatacaatggatctgccagaagagctccctggagtgaaaccttttacccggggtccgtatcctactatgtatacttttcgcccttggacgataaggcaatacgctggattctcaactgtggaagaaagtaataaattttacaaggataacattaaggccggccagcagggtcttagtgtggctttcgatcttgccacacaccggggttacgattcagacaatccacgggtgcgtggcgatgtgggcatggcgggggtcgccatcgataccgtggaggataccaagatactcttcgatggcattccattagagaaaatgagtgtatctatgacgatgaacggcgccgtcatccccgtcttagccaattttattgtcacaggcgaggagcaaggagtgcctaaagagaagctgacaggaacaattcaaaatgacatactgaaagagtttatggtcaggaacacatacatattccccccagaaccgtctatgaagattatagcggatatttttgagtacactgcaaagcatatgccgaaattcaactctatctcgatctccggctaccacatgcaggaggctggcgccgacgccatccttgagctggcctacaccctcgcagacgggctggagtattcccgcactggcctccaagccggcttgacgatcgacgaattcgcacccagactgtcatttttctgggggatcggcatgaacttttatatggagatcgcaaaaatgcgcgccggacggaggctttgggcacacctcatagaaaagatgtttcagcctaaaaattccaaatctctgctgctcagagcccactgtcagacgagcggatggtccctgaccgagcaggatccgtacaacaatattgtgagaaccgccatcgaggctatggctgctgtgtttgggggcactcaaagtctccatacaaatagcttcgacgaagctctggggcttcctacagtgaaatccgccagaatcgccagaaatacccagattattatccaggaggaaagtggcattccgaaggttgcagacccatggggtggctcctatatgatggagtgtctgacaaatgatgtctatgacgctgcccttaagctgatcaatgaaatcgaggaaatgggcgggatggcgaaagctgtggctgagggcatcccaaagttgagaatagaagaatgtgcggccaggcggcaggctcgcatcgactctggtagtgaggtgatcgtgggcgttaacaagtaccagctggaaaaggaagatgctgtggaggtcctggccatcgacaatacctccgtgaggaatagacagatcgaaaagctcaagaagatcaagtcctcccgggaccaagctttggcggagcgttgtctggctgccctcactgaatgtgcggcatcaggggacggtaatattctggcgctcgctgtggacgcaagtagggccaggtgcactgtgggggaaattaccgatgccctcaagaaggtttttggcgaacacaaggccaatgaccgcatggtgtcaggggcataccgccaggagttcggcgagagcaaggagatcacgagtgcaatcaagcgcgtccacaagttcatggaacgtgaggggcgcagacccagattactcgtcgcgaaaatgggtcaggatggccatgaccgcggcgcgaaagtgatagctactggatttgcagatctggggttcgatgtcgacattggccccctttttcagacccctagggaggtcgcccagcaggccgttgacgcggacgtccacgccgttggcgtttcaacgctggctgccgggcataagaccctggtgcccgagcttattaaagagctgaatagcctgggcaggcctgacatcctcgttatgtgcggcggggtcatccccccgcaagactacgagttcctgttcgaggttggcgtctcaaacgtgttcggcccagggacacgcatccctaaagcagcagttcaggtgctggatgacattgagaagtgtcttgagaaaaaacagcagtctgtg

SEQ ID NO: 18 - DNA, 2250 bp, Artificial Sequence
  Codon optimized sequence that encodes an MCM polypeptide with the I671V mutation
atgctgagagcgaaaaatcaactcttcctattgtctcctcattatctccgccaggttaaggagtcttccggaagccgtttgatccagcagcggctactgcatcagcagcagcccttgcacccggagtgggcggctctcgccaaaaaacagcttaaaggtaaaaatccagaggatctcatctggcacacaccagaaggcatcagcattaagcccctgtactcaaagagggataccatggatctcccggaggagcttccaggggtgaagcctttcaccagggggccgtaccccactatgtacacctttagaccatggacgattcgtcagtatgcgggctttagcaccgtggaagagagtaacaagttttataaggacaacatcaaagccggacaacagggtctgtctgttgctttcgaccttgccacacaccggggctatgattctgacaacccacgtgtgcgtggcgacgtgggtatggcaggcgttgccatcgacactgtcgaggacaccaaaattctattcgatggaatccccctcgaaaagatgtccgtttctatgacgatgaacggagccgtgatacccgtgctggccaattttattgttacaggcgaggaacaaggtgtcccgaaggaaaagctgactggaacgattcaaaatgatatactcaaggagtttatggtacgaaacacttatatttttccacccgagccctctatgaaaatcatcgcagacatattcgagtacacggccaagcatatgcccaaatttaacagcatctcaattagcggataccacatgcaagaggcgggcgcagacgcgattctggagctggcctacacattagctgatggcctcgagtactcccgcaccggcctgcaggccggactgactatagacgaatttgcgcctaggctctcctttttctgggggattggaatgaatttctacatggagatagcaaagatgcgcgctgggcgccgtttatgggctcatctaattgaaaaaatgttccagcccaaaaatagtaaatccttactgctgcgggcccactgccagacttctgggtggtcactgaccgagcaggacccctacaataacattgtcaggaccgccattgaagcaatggctgctgtttttggggggacccagtccttgcatacaaacagttttgatgaagccctgggactgccaactgttaaaagcgccagaattgcccgtaacacccagataatcatccaggaggagtccggtattccaaaagtggccgacccctgggggggtagctatatgatggagtgtctgaccaacgacgtctatgacgccgcacttaagctaattaacgagattgaggaaatgggtggaatggccaaagccgtagctgaaggtatcccaaagctgcgcattgaggaatgcgccgctagacggcaggcgcgaatcgactctggtagtgaggtcatcgtcggggtgaataagtaccagttggagaaggaggatgcagtagaggtactggctatagacaacacaagtgtccgcaaccgacagatcgagaagctcaaaaagataaagagctcaagggatcaggccctcgccgagcgctgtctcgccgctcttaccgagtgtgctgccagtggtgacggaaacatattggccctcgccgtggacgcttcaagggcacggtgtacagtgggtgagattactgatgcactgaagaaggtattcggagaacacaaggctaacgatagaatggtatccggggcctatcggcaggagttcggagagtcaaaggagattactagcgcaatcaagagagtgcataaattcatggagcgcgagggtagaagaccacgacttctggtcgctaaaatgggccaagacggtcatgatcgcggtgcgaaggtcattgctacaggtttcgccgacttgggctttgacgtcgacataggcccactcttccagaccccccgcgaagtagcccagcaggccgtggacgccgatgttcacgccgttggagtgtcaacgttagccgctggccacaagacgctagtgcccgagttgattaaggaactcaactcactgggccgacccgacattctcgttatgtgcggaggggtgattccaccacaagattatgagttcctgtttgaggtcggagtctccaatgtatttgggcctggaacgaggatacccaaggccgctgttcaggtgctcgacgatatcgaaaagtgcctggagaaaaagcagcaatctgtg

SEQ ID NO: 19 - DNA, 2250 bp, Artificial Sequence
  Codon optimized sequence that encodes an MCM polypeptide with the I671V mutation
atgctcagagcaaagaaccagctgttcctattatcccctcactacctgcggcaggtcaaggagagttcagggagtcgccttatccagcagaggctgttacaccagcagcagccacttcatcctgagtgggctgccctggctaagaaacaactgaaagggaagaaccccgaggacctgatctggcatacacctgagggcatctccatcaaacctctgtactctaaacgagacaccatggacctgccggaagagttgccaggagtgaaaccctttacacgagggccttatccaaccatgtatacctttaggccttggaccataagacagtacgccgggttttcaaccgtggaggagtctaataagttttacaaggacaatatcaaggctggccagcagggcctgagtgtcgcgtttgatctggccacacatcggggctatgatagtgacaacccaagggttcgtggcgacgtgggtatggccggtgtggctatagacacagtggaggacactaagatcctgtttgacgggattcctcttgagaagatgtccgtcagcatgaccatgaatggcgccgtgattcctgttttggcaaacttcattgtcactggggaggaacagggcgttcccaaggaaaagctgacagggactatccagaatgatatactgaaagagttcatggttcggaatacatacatattccctcctgaaccttccatgaagatcatcgctgacattttcgaatatacagcaaagcacatgccaaaatttaacagcatttcgatttcaggctatcacatgcaggaggctggcgctgatgccatcctcgaattagcgtacactctagctgatgggctggagtactcaaggacaggcctccaggccggcctgacgattgatgagttcgctcctcgcctctcttttttctggggcatcggtatgaacttttatatggagatcgcgaagatgcgggccggccgcaggctttgggctcatctgattgaaaagatgtttcagccaaagaatagcaaatcactgctgttacgcgcccattgtcagacaagcggctggagcctgaccgagcaggatccttataacaatatcgtacggacagccattgaagcaatggccgcagtcttcggcggaacccagagcctgcatactaatagcttcgatgaggctcttggtctcccaaccgtcaagtccgcccggatcgccaggaacacccagatcattattcaggaggagagtggtatccctaaagtggctgacccttggggcgggagctacatgatggaatgcctcaccaacgacgtttacgacgcagccttgaaactgatcaacgagatcgaagagatgggcgggatggccaaggccgtagccgaaggaatacccaaactccgaatcgaagaatgcgcggctaggcggcaggcacggattgactcaggcagcgaggtgatagttggggttaacaagtaccagctagagaaggaggacgctgtagaagttctggcaatcgacaacaccagtgtgagaaatcgtcaaatagaaaaattgaagaagataaagtcatcccgggaccaagccctggccgagagatgtctcgccgcattgactgagtgtgccgcgtccggcgacggcaacattctagctctggctgtcgacgcctctcgagccaggtgtacagtgggcgaaatcaccgacgctttgaagaaagtcttcggggagcataaggctaacgataggatggtgtctggagcttatcgccaggaattcggggagtctaaagagatcacttctgcaattaagcgggttcacaaattcatggagagagagggcaggcggccacgattattggtagccaagatgggccaggatggacacgataggggcgccaaagtgattgctacgggcttcgccgatctgggatttgacgtggacattgggcctttgttccagacccctcgagaagtcgcccagcaggccgtcgacgcagatgttcacgccgtgggtgtgtccacgctagccgcaggacacaagacattggtgccagagcttatcaaagagctgaactccttgggcaggcccgacatattggtcatgtgtggcggcgtaatcccacctcaggattatgaattcctatttgaggttggggtctcaaacgtgttcgggccagggactaggatcccgaaggccgcagtccaggttctggatgacattgaaaaatgtctggagaagaagcaacagagtgtg

SEQ ID NO: 20 - DNA, 2250 bp, Artificial Sequence
  Codon optimized sequence that encodes an MCM polypeptide with the I671V mutation
atgcttagggccaagaaccagctgtttctgctcagccctcactatttacggcaggtcaaggagagctcaggatccaggctgattcagcagcgtttgctgcaccagcagcagcccctccacccggagtgggccgcactcgctaagaaacagctgaaagggaagaatcctgaggacttgatctggcacacaccagagggaatcagtatcaagcctctgtacagtaagcgggacacaatggacctacctgaagaactccccggagtgaagccgttcaccagaggaccttacccaaccatgtatactttcagaccgtggacaattagacagtatgctggattttccactgttgaggaatcaaacaagttttataaggataacatcaaagcgggtcaacaggggctgtctgtggcattcgatttagcaacccacaggggctacgactcagataatccacgagtgagaggtgatgtgggcatggcaggcgtggctattgatacagtggaggacacaaagatactctttgatggaatccctctggagaagatgtccgttagcatgactatgaacggtgccgttattcccgtgctagcaaacttcatcgtgactggggaagaacagggggttccaaaggagaaattaaccgggaccatacagaacgacattctcaaggagtttatggtgcgtaacacttacattttcccgcctgaaccaagcatgaagatcatcgccgatattttcgagtatacagccaagcacatgccgaagttcaacagtatctctatctctggataccatatgcaggaggctggtgcagacgccattctagaactagcgtatacactggccgatggattggaatacagcagaacaggcctgcaggccggactgactattgacgagttcgcccctcggctttcctttttctggggcatcgggatgaacttctatatggaaatcgccaaaatgagggcaggccggcgactgtgggctcatctgatcgagaagatgtttcagccaaaaaacagcaaatctttgcttcttagggcccactgccagacttcagggtggagcctcactgagcaagacccatacaacaacatcgtcagaactgcaatcgaggccatggctgccgtattcggtggcacacagtctttgcacactaactcattcgatgaggcgctcggcctgccaactgtgaagtctgccaggattgctcgaaatacgcagattatcattcaggaggagagcgggatccccaaggtggccgacccatggggtgggagttatatgatggagtgtctgacaaatgacgtgtatgatgcggcccttaagctcattaacgagatagaggaaatgggcggtatggccaaggccgtcgctgagggtattcctaagctaaggatcgaagagtgcgctgctcgcaggcaggccagaattgatagcgggtctgaagtgatagtgggcgtgaacaagtatcagctcgagaaggaagacgctgtagaggtgctagccattgataacacctccgtgcgaaataggcagatcgagaaattgaagaagattaagtcttcacgggaccaggcacttgcagagcgatgtttagcggcactgaccgaatgcgctgctagtggtgacggtaatattctagctttggcagttgatgcgtctagagctaggtgtactgtgggcgaaataactgacgctctcaaaaaagtgttcggagagcacaaggctaacgaccggatggtgtccggagcctatcgacaagagttcggggagtctaaagaaattacaagcgccataaagagagtccacaagtttatggaacgagagggtcgtcgcccgcgactgcttgtggccaaaatgggtcaggacggacatgaccgaggagccaaagtaatagcgacaggcttcgcagatctcggctttgatgtggacattgggcctctttttcagacccctcgcgaggtagcccagcaagccgtggacgctgatgtgcatgcagtcggagtctccacgctggcagccggccacaaaaccttagtgcccgaattaattaaggagctgaacagtttggggaggccagatattttggtcatgtgcggaggcgtaattcctccgcaagattatgaatttttgtttgaggtaggcgtcagtaacgtgttcggacccggaacacgcattccaaaagcagcagtgcaggtcctcgatgatatcgagaagtgcctcgagaaaaagcagcaatcggtg

SEQ ID NO: 21 - DNA, 2250 bp, Artificial Sequence
  Codon optimized sequence that encodes an MCM polypeptide with the I671V mutation
atgttacgcgcgaaaaatcaattatttctactgtcaccccattatcttcgccaggtgaaggaaagctccgggtcaagactgatccagcaaaggctcctgcaccagcagcagcccctccaccccgaatgggctgcccttgccaagaaacagttgaagggcaaaaacccggaggacttgatatggcacacaccagaagggatcagcattaagccactgtactccaagcgagacaccatggacctgcctgaggaactgcccggcgtgaaaccttttacacgtgggccctaccctacaatgtacacatttcgcccctggacaataagacagtacgccgggttctcaaccgtggaggagtctaacaaattctataaggacaatataaaggcaggacagcaagggctctctgtggcattcgatctggcaacacatcgtgggtatgactccgacaacccacgtgtgcggggggacgtgggtatggccggagtcgcaatcgatacagtcgaggatacaaagatcctcttcgatggcattccactggaaaagatgagcgtgagtatgacaatgaacggggcagtcattcctgtgctggccaatttcattgtgacaggggaagagcaaggtgtccccaaggagaaactgactggtacgatccagaacgatatcctgaaggagtttatggtgcggaatacttacatcttcccccccgaaccatcaatgaagatcatcgccgacattttcgagtataccgccaagcacatgcccaagtttaactcaattagcattagcgggtatcatatgcaggaggccggagctgatgccattttggagctggcatatactctggccgacggtctggagtattcaagaacaggcctgcaggccggtctgaccattgatgagtttgctccccgccttagctttttttggggaattggaatgaatttctacatggaaattgctaagatgagggccggcagaaggctctgggcacacctcatcgaaaagatgtttcagccaaagaattcgaagtcactcttgttaagggcgcattgtcagacgtctggctggtctctaaccgaacaagacccctataacaacatagtcagaacagccatcgaagcaatggctgctgtcttcgggggcacccagagcctgcataccaatagtttcgatgaagcccttggactgcctaccgtgaagagcgcacgaattgccaggaatacacagattataatccaggaggaatccggcattcccaaggtcgccgatccttggggcgggagctatatgatggagtgtctcactaatgacgtgtatgacgcagctctgaagctgatcaacgagatcgaagagatgggcggcatggcgaaagccgtggctgaagggatccccaaattacgaatcgaggagtgtgccgctcgccggcaggcccgaatagatagcggatctgaagtcatcgtgggagtaaacaaataccagctggaaaaggaagatgccgtcgaggtgttagcgatagacaacacttcggtaaggaacaggcaaattgaaaaattgaaaaaaattaagagcagccgcgaccaggcattggctgagagatgtctcgccgccttgacagaatgcgctgcctcgggtgacggaaacatcctcgcgctggcggtggacgcctctcgagcgcgctgtactgtgggcgagataactgacgccctgaagaaagtgttcggcgagcacaaagctaacgaccggatggtctcgggagcctaccgtcaggagttcggcgagagtaaggaaataacaagtgccattaagcgagttcacaaatttatggagagggagggacggcggccccggctcctggtcgctaaaatgggacaggatggacacgaccgaggagcaaaagtgattgctactgggtttgctgatctaggatttgatgtggatatcggccccctgttccagactccccgcgaggtggcgcaacaagctgtggatgccgacgtccacgcggtgggcgtgtcaactctggctgccggacacaagaccttagtgccagagctgattaaggagctgaactccctaggtcgcccagacattcttgtaatgtgtggcggagtgatccctccgcaggactatgaattcctcttcgaagttggggtcagcaacgtgttcgggcctggtacccgcatccccaaggcagctgtccaagtcttggacgatatcgagaagtgtctcgagaagaaacaacagtccgtt

SEQ ID NO: 22 - DNA, 2250 bp, Artificial Sequence
  Codon optimized sequence that encodes an MCM polypeptide with the I671V mutation
atgttgcgagccaaaaatcaattgtttctgttatctccacattacctgagacaggtgaaggagagttctggtagtaggctgattcaacagaggttactccatcagcagcaacccctgcatcctgagtgggcggctctcgcgaagaaacaactgaaaggaaaaaaccctgaagatttgatttggcacactcctgaggggatttcaatcaagccgctgtactccaagcgcgacacaatggatttgcctgaggagttgcccggcgttaagccgttcacccgagggccctaccccactatgtacaccttccgcccctggacgatccggcagtatgcgggattcagtacggtggaagaaagtaacaaattttataaggacaacattaaagcaggccaacagggcctaagcgtggctttcgacctggctacccataggggatacgactcagacaacccccgagtacggggagacgtggggatggcgggagttgccattgacacagttgaagacaccaaaatcctgtttgatggcatccccctggagaaaatgtctgtttccatgacgatgaatggtgccgtgattcccgtgctggcaaatttcatcgttacaggggaagagcagggcgtgccaaaagagaagctgaccggtaccatacagaatgatattctgaaagagtttatggtgcggaacacatacatcttcccccctgagcctagcatgaagataatagcagacatttttgagtacaccgccaagcatatgcctaaatttaacagcatcagtatctccggctatcacatgcaggaagccggggcagatgctatactggagctggcttacactctggcagacggactggaatactctcgaacaggactgcaagcgggactgaccatcgatgaatttgctccacgactgtcgttcttttggggaatcggcatgaacttctatatggagatcgccaagatgcgggcaggccgtcgtttgtgggctcatctgatcgagaagatgttccaaccaaagaattccaaaagtttgctgctccgggcacactgccaaacttcagggtggagcctgacagaacaagacccctataataacattgttagaacggccatagaggcgatggcagctgtcttcgggggcacacagtccttgcacacaaacagctttgacgaagccttgggccttccaactgtgaagtcagccaggattgccagaaacacccagatcatcatccaagaggaatctggcatccccaaagtggccgacccctggggcggcagctatatgatggagtgtctgaccaatgacgtgtatgacgcagcactgaagctcatcaatgaaatcgaggagatgggcggaatggccaaggccgttgccgaaggaataccgaaattgcggatagaagaatgtgcggcccggagacaggccaggatcgacagcggttctgaggtgatcgtgggtgtcaataagtatcagctcgagaaagaagatgccgtggaggttctggccattgataatacgtctgtgcgtaatcgacagattgaaaaactcaaaaaaatcaaatccagcagggaccaagcgctggccgagcgatgtctggcagctctcacagaatgtgcggcttcaggggatggcaatatcctagctctggccgtcgatgcaagccgagcccgatgtactgtgggcgaaattactgacgcgctgaagaaggtgttcggagagcataaggcaaatgatcggatggtgtccggcgcttaccgccaagagtttggcgagtcaaaagagattacgagtgccattaagcgggtgcacaaattcatggagcgcgagggtcgcaggcccaggttgcttgtggcaaaaatggggcaagatgggcacgaccgtggagcaaaagtgatcgccacaggattcgccgatcttggttttgacgtcgatattgggccattgtttcagactcctagggaagtggcccagcaagctgtcgacgccgatgtgcatgccgttggggtctccaccctggctgccgggcacaagacactggtgccagaactgattaaggaactgaattctctgggacgacctgacattctggttatgtgtggtggcgttatccccccacaggattatgaattcctattcgaggtaggagtgtctaatgtgttcgggcctggtacgagaatcccaaaagctgcagttcaagtgctggatgacattgagaagtgtctggaaaagaaacaacagtcagtg

SEQ ID NO: 23 - DNA, 2250 bp, Artificial Sequence
  Codon optimized sequence that encodes an MCM polypeptide with the I671V mutation
atgcttagagctaaaaaccagttgttcctgctgtcgccgcactatctaaggcaggtaaaagagtcgagcggctctcggctgatccagcaaagactattacaccagcagcaaccgctgcatcctgagtgggctgcactagccaagaaacagctaaagggcaagaatccagaggacctgatatggcacactcccgaaggcatttctattaaacccctctatagcaagcgtgacaccatggatcttcctgaagaactccccggcgtaaagcccttcacgcggggcccctatcccactatgtacaccttccgcccctggactattcgtcagtacgccggtttctccaccgtggaagaatctaataagttctacaaagacaatatcaaggccgggcagcagggactcagcgtggcttttgatctcgctacccatcgcggttacgacagtgacaaccctcgcgtgagaggtgatgtcggtatggcgggagtggcaatagataccgttgaagacactaagatccttttcgatggcattcccctggagaagatgtcggtgtccatgacgatgaatggagcagtcatccctgtgttagcaaatttcatagtaaccggagaggaacagggtgtccctaaggagaagctgacaggaaccatccagaacgatattctaaaggaattcatggtcaggaatacctatatctttccgcccgaaccaagtatgaaaatcatcgccgacattttcgaatataccgctaaacacatgccgaaattcaacagcataagcatttcaggctatcacatgcaggaggccggagcagacgcaatcttagaactggcttacacactggcggatggactagaatactctaggactggcctgcaggccgggctcacaattgacgaatttgctccacggctttcttttttctgggggatcggtatgaacttctacatggaaatagccaagatgagagctgggagacggctgtgggcacacctgatcgaaaaaatgttccagccgaaaaatagtaaaagcctgctgctgagagctcactgccagacgagcggctggtctctgacagagcaggacccttacaacaacatcgtccgcaccgctattgaggccatggccgccgtatttggcggaactcagtccttgcataccaatagtttcgacgaagctctgggattgcccaccgttaaatccgctcgtatcgcccgcaacacgcagataattattcaggaagagagtggcattcctaaggttgctgatccttggggagggagttacatgatggaatgtttaaccaacgacgtgtatgatgccgccctcaagctgatcaatgaaatcgaggaaatgggagggatggcaaaagcggtggcagaaggaattcctaagctcaggatcgaggaatgtgctgctcggcgacaggcacgcattgactccggaagtgaagtgatcgttggcgtcaataaatatcagttggagaaagaggacgcggtcgaagtcctcgctattgacaatacctccgtccgcaacaggcagatagaaaaactcaagaaaatcaaatcgagtcgcgatcaggctctggccgaacgttgcctggccgctctcaccgaatgtgccgcaagtggcgacggcaacattttagcccttgccgttgacgccagccgagcaaggtgcacagtgggggagatcacagatgcccttaaaaaagtgtttggagagcataaagccaacgacagaatggtttctggagcctatcgacaagagtttggagagtccaaggagatcaccagtgccattaagcgcgtgcacaagtttatggagcgcgaaggccggagaccccggctgctagtcgccaagatgggccaagacggacatgaccgaggcgctaaagtaattgcgaccggatttgccgatcttggatttgatgtcgatattggacctctgttccagacccctcgcgaagtagctcagcaggccgttgatgccgatgtgcacgccgtaggcgtatccacgctggcagcaggacataagaccctggttcccgagcttatcaaggagctcaattctctaggcagaccagacatactggttatgtgcggcggcgtaatcccccctcaagactacgagttcctgtttgaggtgggggtgtcaaatgtattcggccctgggactcggatccccaaagcagcagtgcaagtgctggatgacattgaaaaatgcctcgaaaagaagcaacagagtgtg

SEQ ID NO: 24 - DNA, 2250 bp, Artificial Sequence
  Codon optimized sequence that encodes an MCM polypeptide with the I671V mutation
atgcttcgggctaagaaccagttgtttctccttagtccccattacctccgacaggtcaaggaatcttcaggttctcgcctcatccaacaacgcttgctgcatcagcagcagcccctgcaccccgaatgggctgccctcgcaaagaagcaattaaaaggtaagaacccggaggacctgatctggcatacacctgagggcatttccataaagcccctctattcaaaacgcgacaccatggacctacccgaagaactgccgggagtaaagccatttactcgggggccttaccccaccatgtatacatttcgcccctggacaattcggcaatacgccggattctccaccgtggaggaatcaaataagttttataaggacaacatcaaggcaggacagcagggactttctgtagcattcgacctcgccactcacagaggctacgactcagacaacccacgagtcaggggcgatgtgggtatggccggcgtggctatagacacagtggaggacactaagatactttttgacggcatccctctggagaaaatgagcgtgagcatgactatgaatggagccgtaatccctgtcttagcgaacttcatcgtcaccggagaagagcagggcgtacccaaagaaaagcttacagggaccatccaaaacgacatcctcaaagagtttatggttaggaacacctatatttttccgccagagcctagcatgaaaattatcgccgacatctttgaatataccgccaagcatatgcctaagtttaattctattagcattagcggctaccatatgcaagaggccggggctgacgccatcctcgagctggcctacaccctggccgatggattagagtactcaagaacaggccttcaagccggtctaactatagatgaatttgcccctagattatcatttttttggggcattggaatgaatttttacatggagatcgctaagatgcgggctggccggaggttgtgggcccacctgattgagaaaatgtttcaacctaagaacagcaaaagccttttgctacgtgcccactgtcagaccagtggctggtccctaaccgagcaagacccctacaacaacatagtcaggacagctatagaggctatggcagcagttttcggcggaacacaatccctgcacactaactccttcgatgaagctctcggactgccaacagtcaaatccgcccggattgcccgaaatacacaaatcatcattcaagaggaatccggcatccctaaagtggccgacccttggggcggcagttacatgatggagtgtttgaccaacgatgtttacgacgctgccctgaaactgattaatgagatcgaggaaatgggggggatggccaaagcagtagccgagggaatacctaaactgcggattgaagagtgcgcagctagacgccaagctcgtatcgatagtggatccgaggtgattgtcggagtgaataaatatcagcttgagaaagaggatgctgtggaggtgctggctattgataataccagcgtgcggaacagacaaatcgaaaagctgaagaaaataaaatcaagccgagaccaggcactcgccgaacggtgccttgctgccctaaccgagtgcgcagccagcggcgatggcaacatcctagctctagccgtggatgcatcacgcgctagatgcactgtgggggaaatcacggacgctcttaaaaaggtctttggggaacacaaggcaaatgacaggatggtatcaggcgcctacaggcaagagttcggggagtcaaaagagattacctcagccataaagcgagttcacaaattcatggaaagagaggggagacgaccccgactgttggtcgctaagatggggcaggacggccatgacaggggagcaaaggtgatcgccaccggatttgccgatttggggttcgacgtcgacatcggacctttgttccagacacccagagaagttgcccagcaggccgttgatgcggacgtccatgccgtgggtgtgtccacactggccgcgggacacaagaccctggttcccgaattgatcaaagagctcaacagcctgggacggcctgacatcctcgttatgtgtggaggcgtaatcccaccccaggattatgagttcctgttcgaggtgggagtgtccaacgtgtttggccccggcacgagaattcctaaagctgctgttcaagtgctggatgatatcgagaaatgccttgagaagaagcaacaaagcgtc

SEQ ID NO: 25 - DNA, 2250 bp, Artificial Sequence
  Codon optimized sequence that encodes an MCM polypeptide with the I671V mutation
atgctgcgcgcaaaaaaccagcttttcctactctccccccattatctccggcaggtcaaagagtcatccggttccagactgattcagcagagactcctgcaccagcaacagccactgcatccagaatgggcagcattagcgaaaaagcagcttaagggaaagaatcccgaagatctaatctggcacacaccggaaggaatcagcatcaaacctctttacagcaagcgggatactatggacctccccgaagagctccccggtgtgaagccatttaccagaggaccttatccaactatgtacacgttccggccgtggacaatccgacagtatgctggcttctctaccgtggaggagtccaacaagttctacaaggacaatattaaggcggggcagcagggactctccgtggcattcgatctggctacccaccgagggtacgattccgacaatccgagggtgaggggcgacgtggggatggcaggcgttgccattgatacagtagaggatactaaaattttgttcgatggcatccccttagagaagatgtccgtatccatgaccatgaatggtgccgtcattcctgttctcgctaatttcattgtaaccggagaggaacaaggtgtccctaaggagaagctgaccggtacaatacaaaatgatatacttaaagagtttatggtgcgcaatacgtacattttcccaccggaaccaagcatgaagatcattgccgatatctttgaatataccgccaagcatatgccgaagttcaattccattagcatttcaggctaccatatgcaggaggcaggcgccgatgccattctcgaactcgcctacacactggcggatggcctcgagtattcaaggaccggtctgcaagcaggcctgacaattgacgaatttgccccccgactgtcttttttctggggcatcgggatgaatttttatatggagattgcaaagatgcgggcaggacgacgcttgtgggctcacctcattgaaaaaatgtttcaaccaaagaactctaaaagcttactgctcagggcacactgccagacttcaggctggagcctgacggagcaagacccctacaataacattgtgaggacggctatcgaggccatggcggccgtgtttgggggtacccaaagcttgcacactaactctttcgacgaggcgctgggtttaccgaccgtgaagagcgctagaattgctcggaacacgcagattattatccaggaagagtcagggatcccaaaggttgccgatccttgggggggcagttacatgatggaatgcctgactaacgatgtttatgacgctgcactaaaattgatcaatgaaatcgaggaaatgggagggatggccaaggcagtagccgaaggcattcccaaactacgcatcgaagagtgcgccgctaggcgacaggctaggatagatagcggttccgaggttattgtcggtgtcaataaatatcagctggagaaggaagatgccgtggaggttctggctattgataacacctcagtgaggaatagacagattgaaaaactgaaaaagatcaagtccagccgggaccaggcactggcagaacgatgccttgccgcgctgacagagtgcgcagcttcgggggatggtaatattctcgcgctggccgtggacgcaagtcgggctaggtgtacagttggagaaataaccgacgctctcaaaaaagtctttggcgagcacaaagcaaacgaccgaatggtgagtggtgcatatcgtcaggagttcggagaaagcaaggagattacgtcagctatcaagagagtgcacaaatttatggagagagaggggaggcgtccacgcttacttgtggccaagatggggcaggacggccacgataggggcgctaaagtgatcgccactggattcgcggacctgggcttcgacgtggacattgggccattattccagacaccccgcgaagtggctcaacaggcggtggacgcggacgttcacgccgtaggagtatcaaccctagccgcggggcacaaaaccttggtgccggagcttattaaggagctcaacagcctcggcagaccagacatccttgtgatgtgtgggggtgttatccctccgcaggattacgaatttctcttcgaggttggggtgagcaatgtgtttggaccaggtacgagaatccccaaagcggccgtccaagtccttgacgatattgaaaaatgtttagaaaaaaagcaacagtcagtt

SEQ ID NO: 26 - DNA, 2250 bp, Artificial Sequence
  Codon optimized sequence that encodes an MCM polypeptide with the I671V mutation
atgctgcgcgccaagaatcagttgtttttgttgagtccacactacctgagacaggtaaaggagagctccggcagcaggttgatccaacagcgcctgttacaccagcagcaacccctgcacccggaatgggctgcacttgccaagaaacagctgaaagggaaaaaccccgaggatctgatttggcacacgccagaaggtatcagtattaagccactgtatagtaagcgagacacaatggaccttccggaagagctcccaggggtgaaaccttttacgcgtggaccttaccctactatgtatacatttcggccttggaccatccgccagtatgccggattctccactgtagaagagagcaataagttctataaagataatatcaaggcaggacagcaaggtttgagcgtggcctttgatttagccacccacagaggatatgatagtgataatccacgggttaggggtgacgttggaatggccggagtcgcaatcgatacagtcgaggatacaaagatcctgttcgacggcattcctttagaaaaaatgagcgtcagtatgaccatgaatggggccgttattcctgtcctcgccaacttcattgtaaccggagaagagcagggcgttcctaaagagaaattgacggggacgattcagaatgacattttaaaggagtttatggttaggaacacttacatattccctcccgagccatccatgaagataattgcagatatcttcgagtacaccgccaagcatatgcccaaattcaattctatttccataagcggctatcatatgcaggaggcaggggccgatgctatcctggagttagcttataccctcgccgacgggctggaatattctcgtacaggcctgcaggcgggtctgactattgacgagttcgctcctcgccttagctttttttgggggattggtatgaatttctacatggaaatagctaaaatgcgcgccggcaggagactgtgggcccatctgatcgagaagatgttccagcccaagaatagcaaatccttactgttgagagctcactgccaaacctcaggatggtccctgacagaacaggatccttataataacatcgttcgcaccgccattgaggccatggcagccgtctttggtggaactcagagcctgcataccaacagtttcgacgaggcgcttgggctgccgacagtcaagagtgcccgaatcgcaagaaatacccagattattattcaggaggaaagtggcatccccaaagtcgctgatccctggggagggtcttacatgatggagtgtctaactaatgacgtttatgatgccgccttgaaactgatcaatgagatagaggagatgggcggaatggccaaggccgttgcagagggcattccaaaattacgcatcgaggagtgcgccgcaaggcgtcaagcccgcatcgattcaggaagtgaggtcatagtgggtgtcaacaaataccagcttgaaaaggaggacgccgtggaggtgcttgcaatcgataacactagcgtcagaaatcgacaaatagagaagcttaaaaagatcaaaagctcacgggatcaagctcttgctgagagatgcctcgcagccctcaccgagtgtgccgcttccggggatggcaacatactggcgctcgccgtggatgcatctagggctaggtgtacggtgggtgagattactgatgccctgaagaaggtttttggagagcataaggcaaatgacaggatggttagtggagcatatcgtcaagagtttggcgagagcaaggagattactagcgccataaaacgggtgcacaaattcatggaacgagagggcaggcggcctaggcttctggtcgctaaaatgggacaagatggacatgaccggggtgctaaagtgatcgccacaggctttgctgacttggggttcgacgtcgacataggaccactgttccaaaccccccgggaagtcgcgcagcaggcggtcgacgctgatgtccacgctgttggtgtgagtaccctcgcagccggacacaagacacttgtgcctgagcttatcaaagagttaaattccctaggccggccggatatactcgtgatgtgcgggggggttatcccaccccaggattatgagtttctgttcgaggtgggcgtgtctaacgtattcgggcctggcaccagaattcccaaagccgcagttcaggttctagacgatatcgagaagtgcctggagaaaaagcaacaatcagtc

SEQ ID NO: 27 - DNA, 2250 bp, Artificial Sequence
  Codon optimized sequence that encodes an MCM polypeptide with the I671V mutation
atgcttagggccaagaatcaactgttccttcttagcccgcattaccttcgccaggttaaggagtctagtggatccaggctaatccagcagcggctgctacaccaacaacagcctctgcacccagagtgggctgccctcgccaaaaagcagctgaagggaaaaaacccagaggatctcatttggcatacccctgagggaatttctattaagccgctctatagtaaaagggacactatggatctgccggaggagctccctggagtgaaaccctttaccaggggcccatacccgacgatgtatacttttcggccttggactattcggcagtatgccggattcagtactgtggaggagtcaaacaaattctacaaggacaatattaaagccggtcagcagggtctgtccgttgctttcgacctagctactcatagggggtatgatagtgacaatcctcgcgttcgcggagacgtcggtatggccggggtggctattgacaccgtcgaggataccaagatcctgtttgacggcatcccactagaaaagatgagcgtgagtatgaccatgaacggcgcggtgatccccgttctggcaaactttattgttacgggagaagagcaaggagtacccaaagagaaactgacaggaaccattcagaatgacattctgaaagagtttatggtccgaaatacttacatcttcccacctgagccttctatgaaaataatcgcagacattttcgaatacacagcgaagcacatgccaaagtttaactcaattagcattagcgggtaccatatgcaggaagccggtgctgatgccattctagaacttgcctacactctggcagatggcctagagtactcgcggacaggtctgcaggcaggcctgacaatcgatgaattcgcccctcgcctgtctttcttctggggaattgggatgaatttttatatggaaatcgctaaaatgcgagccggacggaggctgtgggcacatcttatcgaaaagatgttccaacccaagaatagcaaatctctgctgctgcgggcccattgccaaacctctggatggtccctgaccgagcaggatccctataataatattgtacgtacggccatagaagcaatggctgcagtctttggcggcacacagagcctccacactaacagcttcgatgaagccttgggccttccgaccgttaagtcagctaggatcgcgcgtaatacccaaattatcatccaggaagaaagcgggattcccaaggttgccgatccctgggggggatcttacatgatggagtgccttacaaacgacgtatacgatgccgcgctgaaactcattaatgaaattgaggagatgggcgggatggctaaggccgtagccgaaggcatccctaagcttagaatcgaagagtgtgctgcaagacggcaggctaggattgactcgggctccgaggtcatcgtcggcgtgaacaagtaccaactggaaaaggaagatgcggtcgaggtgctggcgatcgataatacctcagtcaggaacagacaaattgagaaattaaagaaaatcaaaagcagtcgcgaccaggccttggctgagcggtgtctcgctgccctcacagagtgcgccgcaagcggcgatggcaacatactagccctcgctgttgatgcatccagggcgcggtgcaccgtgggagagataactgacgccctcaaaaaggtattcggggaacataaggctaacgacagaatggtgagtggagcttaccgccaggagtttggtgagagtaaggagataacatcagccataaagagagtgcacaagttcatggagagagagggccggcgacccagactgctcgtggccaagatgggtcaagacggacatgaccggggcgccaaggtgatcgccaccgggttcgcagacctcgggtttgatgtcgatatcggaccgttgttccagaccccacgggaggtcgcccaacaggccgtggatgcggacgtgcatgcagtaggagtgagtaccctcgccgccgggcacaagacattagtccccgagcttataaaggaactcaattcactcgggaggcctgacatactcgtgatgtgcggaggcgtgattcctccacaggactacgaattcttgtttgaggtcggggtgtccaatgtctttggccctggcacgcgtattcctaaagcggcagttcaggtgctcgacgatatagagaagtgcctggagaagaagcagcagtctgtc

SEQ ID NO: 28 - DNA, 2250 bp, Artificial Sequence
  Codon optimized sequence that encodes an MCM polypeptide with the I671V mutation
atgctcagggctaaaaatcaactttttctgctctcgccccactaccttcgccaggtgaaggagtccagcggcagtagacttatccagcagcgtctgttgcatcagcaacagccactgcaccctgagtgggcagcgctggctaagaagcaactcaagggcaagaaccctgaggatctcatctggcacacaccggaggggattagtatcaaacccttgtactcgaagcgggataccatggatctgcctgaagaattgccgggagtcaagcccttcacaagaggcccttatcccaccatgtacacatttaggccctggaccatccgccaatatgctggcttcagtactgtggaggaatcaaataagttttataaggacaatatcaaagccggccaacaaggcttgtctgtggcatttgatcttgctacgcaccggggctacgattccgataacccccgcgtgcgcggagacgtcggcatggcaggcgtggccatcgacactgtggaggacactaaaattttatttgacggtattccactcgaaaaaatgtccgtgagtatgaccatgaacggtgccgtgattcctgtactggccaatttcatagtgactggtgaggaacagggagttcctaaagagaagctgaccggtactatccaaaatgatattcttaaggagtttatggtaagaaatacttacatctttcccccagagccctctatgaaaatcatagctgacatattcgaatacaccgcaaaacacatgccaaaattcaatagcattagtattagtgggtaccacatgcaggaagctggagctgacgcgatcctggaactggcctacaccctggcagatgggctagagtacagcagaaccgggctacaggctggtctcacaatcgacgagtttgctccccggttaagttttttctggggcatcggtatgaacttttacatggaaattgccaagatgcgggcaggaaggcgtctttgggctcatctgatagaaaaaatgtttcagcccaaaaacagtaaatcgttgttgctccgagcacactgccagaccagcggttggagcctgacggagcaagatccttacaacaatattgttcggactgctatagaagccatggctgccgtatttggcgggacacagagcctccacactaattctttcgacgaggccttggggttgcctaccgtgaagagcgctcgtatcgcgaggaatacacaaataattattcaggaagaatcaggcattccaaaagtggcagacccgtggggaggaagttacatgatggagtgtctcactaatgatgtgtacgatgccgccctgaagctgattaatgaaattgaagagatgggagggatggctaaggcagtggccgaaggtattcccaagctccggattgaagaatgtgcagccaggcggcaggcccgtatagactcaggctccgaggtgatagttggagtaaataaatatcagctggagaaggaggatgcggtcgaagtcttggccatcgacaacacatccgtgaggaatcgccagattgaaaagcttaagaagatcaagtcaagcagagaccaggccctcgcagaaaggtgcctggctgctctgaccgagtgtgccgctagcggagacggcaatatcctagccctcgccgtggatgcctctagagctcgatgcacagtgggcgaaattacagatgccctgaaaaaggtctttggagagcacaaggcaaatgacagaatggtctcaggcgcgtacagacaggagttcggggaatcaaaggagatcacaagtgcaattaagcgggtccacaagttcatggagcgggaagggcggagaccccggcttctggtcgcaaagatgggacaggatgggcatgacagaggtgccaaagtgatcgccacaggatttgccgatttgggattcgacgtggatataggtcccttatttcagaccccgcgtgaagtagcgcaacaggcagtggacgcagacgtccacgccgtcggggtgagtaccctggcggcgggacacaaaactctagtccccgagctcattaaagagctcaactctctgggcaggcccgatatcctagtaatgtgtgggggggttattccaccccaggactacgagtttctatttgaagtgggagtgtccaacgttttcggccctggcacaagaattccaaaggccgccgtgcaagtgctcgatgatatcgagaagtgcttggagaagaaacagcagtctgtt

SEQ ID NO: 29 - DNA, 2250 bp, Artificial Sequence
  Codon optimized sequence that encodes an MCM polypeptide with the I671V mutation
atgttgagagccaaaaaccagctcttcctgctgagccctcactacctcaggcaggttaaagaaagctctggctcacgtctaatccagcaacgcctgctccaccagcagcaacccctgcatccagagtgggccgctttagccaagaaacagctgaaaggtaagaatcctgaggatcttatttggcatactcctgagggtatcagcatcaaaccactgtattcaaagcgggataccatggacctgcccgaggaacttccgggggtgaagcctttcacacgggggccctacccaaccatgtatacattccgaccttggacaatccgccagtatgcggggttttctactgtggaagaatctaacaagttctacaaggacaacattaaagctggacagcagggtctctccgtcgcctttgacttggccacacatagggggtacgactctgacaaccctagggtccggggcgatgtgggtatggcaggcgtggcaattgacaccgtcgaggacactaaaatcctctttgacggcatccccttggaaaagatgtctgtatcgatgaccatgaatggcgcagttatccctgtgttggccaactttatcgtaactggggaagagcagggtgtcccaaaagaaaagttaacaggcaccatccagaatgacatcctcaaagagtttatggtccggaatacatatatctttccaccggagccgtccatgaagattattgccgatattttcgagtatactgccaaacatatgcccaagttcaatagcatctctattagcggttatcacatgcaggaggccggcgcagacgccatattagaactggcttacacattggctgatggcctggaatatagtcggaccggccttcaggctggtcttaccatcgatgagttcgcaccacgcttaagtttcttctggggaattggaatgaatttctatatggaaatcgcgaaaatgcgtgcaggtcgccggctctgggctcatctgatcgagaagatgtttcaacctaagaattccaagagcctgctgctccgagctcattgtcagaccagtggttggagcctaaccgagcaagacccttacaacaatatcgtgcggaccgccattgaagccatggcagctgtttttggtggcacccagtctttgcataccaactcgttcgatgaagcgcttggactaccaaccgtgaagtctgcccggatagctcgaaacactcagattattatccaggaggagtcggggatacccaaggtcgctgatccttggggcggtagctatatgatggagtgtttgacaaatgacgtgtacgacgcagccctcaagcttattaacgaaattgaggaaatgggtgggatggcaaaagctgttgccgagggaatccccaagctgagaatcgaggagtgtgccgcacggaggcaggctcgtatagacagcggtagcgaggttatcgtgggagtgaataagtaccaacttgagaaggaagatgctgtcgaggttcttgctattgacaacaccagtgtgcgcaatcgccagatagagaaactgaagaaaatcaagagctcaagagaccaggcactagccgagcggtgcctggccgcattgacggagtgcgccgcatccggcgatggcaatatactcgccttggctgtagacgcctcacgcgcccgctgtacagtcggtgagataaccgatgcactcaaaaaggttttcggcgaacataaggccaacgaccgaatggtgtctggagcctatcggcaggaatttggggagtctaaggaaatcacatctgcgatcaagcgggtgcacaagtttatggaaagagaaggacgccggccaagactcctggtcgccaaaatgggccaggatgggcatgatcggggggcaaaagttattgccaccggatttgctgatttgggatttgatgtcgatattggcccactcttccagactccacgcgaggtggcccagcaggctgtggacgctgatgtccatgctgtcggtgtgagtactttggcagccggccataagacccttgtcccggagctcatcaaggagttgaattccttaggtcgcccggatattttggttatgtgtggaggcgtaatacctccccaggactacgaatttctgtttgaggtcggtgtgagtaatgtattcggtccgggaactaggatcccaaaggctgctgtgcaggtcctggacgatatcgagaagtgccttgagaagaagcagcagtctgtt

SEQ ID NO: 30 - DNA, 2250 bp, Artificial Sequence
  Codon optimized sequence that encodes an MCM polypeptide with the I671V mutation
atgcttcgcgcgaagaatcagttatttctgctgagcccccactacctgcggcaggtgaaggagtcctcaggaagtcgcctgattcagcagagactgttgcaccagcagcagcccttgcaccccgaatgggccgcacttgctaagaagcagttaaagggtaaaaaccctgaagatttaatttggcacaccccagagggcatttccatcaaaccattgtattctaagcgggatacaatggatctaccagaggaactccccggggtcaagccatttactaggggaccataccctacgatgtacacatttcgaccatggactatccgccagtacgcagggttttccaccgttgaggagagcaataaattttacaaggacaatataaaagccggacagcagggactgagtgtggcatttgatctggctacccaccggggctatgattcagacaacccaagagtgagaggcgatgtgggcatggccggcgtggccatcgatacggtggaggacactaagattctttttgacgggattcccctggaaaagatgagtgtgtccatgaccatgaacggcgctgtgatacccgttcttgctaattttatcgtgactggcgaagagcaaggcgtgcctaaagagaagctcacgggcaccatccaaaatgacattctcaaagagttcatggtgcggaacacatatattttcccacccgagccttcaatgaaaatcattgccgacattttcgagtataccgcaaagcacatgcctaagtttaactccatatctatttctggctaccacatgcaagaggccggcgctgacgcgatcttagagcttgcatacacacttgccgatggtttggaatacagccgcacggggttgcaggccggattaactatcgatgaattcgctccaaggctgtcatttttctgggggataggaatgaatttttatatggaaatagcaaaaatgcgagcaggccgccgcctctgggcccaccttatagaaaagatgtttcagcccaaaaactcaaagtcattactcctccgtgcccattgccaaacatccgggtggtcattgaccgaacaggacccttataacaacatcgtgcgtacagctatcgaggccatggctgccgtcttcggagggacacagtctttgcacacaaacagctttgacgaggctttgggactgcctaccgtgaaatctgcacggatcgcacggaacacacagatcatcatccaggaggaatctggcattccaaaggtggccgatccatggggggggagttacatgatggagtgtctgactaacgacgtctacgatgccgctctaaagctgatcaatgaaattgaggaaatgggcggtatggccaaggccgtggccgaaggcatccccaaattgaggattgaggagtgtgctgcccgaaggcaggcaagaattgattcagggtctgaagtgatagttggggtcaacaagtatcaactggaaaaggaagacgcggtagaagtgctggctatagacaacacctctgttaggaacagacaaattgagaagctgaaaaaaatcaagtcatcccgggaccaggctctggctgaacgatgcctcgccgctctcactgagtgcgccgcatccggggacggcaatatactggccctcgccgtggacgccagtagagctcgttgcactgtcggcgagataaccgacgcacttaaaaaggtttttggggaacataaggccaacgacagaatggtgtctggagcgtaccggcaggaatttggggagtcaaaagagatcacctccgccatcaaaagggtccataagttcatggagcgcgaaggcagacggccaagactcctcgtggctaagatgggtcaggatggacacgaccggggagcgaaggttatagcaacaggctttgctgatctaggctttgatgtggatataggaccgcttttccagacccctagagaagtcgcacagcaggctgtggacgccgacgttcacgccgtgggcgtgtctacgctcgcagctggtcacaagactctggtacccgaactgattaaggagctaaattcattaggaaggccagatattctggtgatgtgtggcggcgtgatcccaccgcaggactacgaattcctgttcgaggttggagtaagtaatgtattcggacccggaaccaggataccgaaggccgcagtgcaggtactggacgacattgagaagtgcctcgaaaagaagcagcagtcagtg

SEQ ID NO: 31 - DNA, 2250 bp, Artificial Sequence
  Codon optimized sequence that encodes an MCM polypeptide with the I671V mutation
atgctgcgggcaaaaaatcagctctttttgctctcacctcactatttgcgccaggtcaaggagtctagcggatcaaggctgattcagcagcggctgttgcatcagcagcagcctctacatcccgaatgggctgccctggctaagaagcagctcaaaggcaagaaccctgaggatttgatttggcacacccccgaggggatatctattaagccactatacagtaagcgggacacaatggatctgcccgaggagctccctggagtcaagccttttacccgtggaccgtacccaactatgtacactttccggccctggacaattcgtcaatacgcaggtttctcaaccgtcgaggaatcaaataagttttacaaggataatataaaggctggacagcagggattgtctgtcgccttcgacctcgccactcatagagggtacgactccgataacccacgtgtgcgtggcgacgtcgggatggccggtgtggcaatagatacagtggaagatacaaagatcctgtttgatggcattcctctggaaaagatgagcgtgagcatgaccatgaatggtgccgtcattcccgtgctcgcgaattttatcgttactggagaagagcagggagttccaaaagaaaagttgactggcaccatccagaacgacatactgaaggagtttatggtgaggaatacttatatatttccacccgagcccagcatgaagattattgcagatattttcgagtacaccgctaagcatatgcccaagtttaacagcatcagcataagtggataccacatgcaagaggcgggtgccgacgccattcttgagctggcctatacgttagctgatggtttggaatatagtcgaactggattgcaggcaggcttgactatcgacgagtttgccccacggctttcattcttttggggtataggaatgaacttctacatggaaatcgctaaaatgcgcgccgggaggcggctgtgggctcatttgattgagaagatgtttcagcctaagaacagcaaatcgctgctgctgcgcgcacactgtcagacgagcgggtggtcactaacagagcaagatccttataacaacatcgtcagaacggcaatagaagccatggccgccgtgtttggaggaacccagtccctccataccaactcctttgacgaggctcttggcctgcccactgtgaaatctgcgaggattgcccggaatacccagatcatcatccaggaggaaagtggaatcccaaaggttgctgacccctggggaggttcttacatgatggagtgtttaactaacgacgtatacgatgccgctctgaaacttatcaatgagatagaggaaatgggaggcatggcgaaagcggtggccgaagggatccccaagttacgtatcgaagagtgtgctgcgagaagacaggcccgcatcgatagcgggtcagaagtcattgtgggggtcaacaaataccagctggaaaaggaagatgctgtggaagtcctggcgattgataatacatctgtgcggaataggcagatagaaaagcttaagaagatcaagtcgagccgagatcaggccctagcagaacgctgtctggctgccctgacggagtgtgctgcgagcggcgatggaaatatcctggcactggccgtcgacgccagccgtgccaggtgcaccgtgggtgagataaccgacgcccttaagaaagttttcggcgaacataaagccaacgataggatggtatccggcgcttatagacaagagtttggcgaatctaaggagatcacaagtgcgattaagagggtacacaaatttatggaaagagaaggcagacgtccgcggcttctagtggccaaaatgggccaagatgggcatgatcgaggcgctaaggttattgctacagggtttgccgatctgggtttcgatgttgatattgggcccctgtttcaaacacccagagaagtggctcaacaggccgtggacgccgacgtgcacgccgtgggggtcagcacactggccgccggccacaagaccctggttcccgagctgatcaaggaactgaactctcttggacgcccagatatcctcgtgatgtgtggtggagtcatcccccctcaggattacgaattcctgtttgaggttggcgtgtcaaacgtttttggtcctggtacgcgcatcccgaaagcagcagtgcaagtgctggatgatatcgagaagtgcttggaaaaaaaacagcagagtgtc

SEQ ID NO: 32 - DNA, 2250 bp, Artificial Sequence
  Codon optimized sequence that encodes an MCM polypeptide with the I671V mutation
atgctgcgcgcaaaaaatcagctcttcctccttagtccccattacctgcggcaggtgaaggagagtagcgggagccggctgatccaacagcgattgctgcatcagcagcagcctctgcacccagaatgggccgccctcgccaagaaacagcttaagggaaagaaccctgaggacctgatctggcacacacccgagggcattagtatcaagcccctgtactcgaaaagggatactatggacctgccggaagagttgccaggcgttaagccgtttactagagggccgtatcctaccatgtacacttttcgaccatggaccatacggcaatatgcaggcttttctactgtcgaggagagcaataagttctataaagacaatatcaaggccggccagcagggccttagcgtggccttcgatctggctacccatagagggtacgatagtgacaatccacgggtgcgcggcgacgtcggcatggctggtgttgccatagacacagtggaggacacaaaaatcctgttcgatgggatccccctggagaagatgagcgtctccatgacaatgaacggcgcagtcattcccgtgctggcgaacttcatagtgactggggaggaacagggcgtgcctaaggagaagttgactggcaccatccagaatgatattctgaaagaatttatggtacgcaatacatacatttttcctcccgaacccagcatgaaaataatagcagacatttttgaatatactgcaaagcatatgcctaagttcaactccatttccatctctggataccatatgcaggaggccggagcagacgccatactggagttggcctatactctggcagatgggttggagtacagcaggacggggctgcaggccggcctcaccattgatgagttcgccccacggctaagcttcttctggggcattggcatgaatttttacatggagatcgcaaaaatgcgcgcggggagacggctgtgggcacacttaattgaaaaaatgttccagcccaagaattcaaagtctctcctgttgcgcgcgcattgccagacctctgggtggtcactgactgagcaagatccatacaataacatcgtgcggactgcaatagaagctatggccgccgtttttggagggactcagtcactgcataccaacagcttcgatgaggccctgggactgccaacggtcaaatcagcacgcatcgctcggaatacccagatcatcatccaagaggagtcaggtatccccaaggtggctgacccatggggtgggagttatatgatggagtgcctgaccaacgacgtgtatgatgcggccctgaagcttatcaatgaaatagaggaaatgggaggaatggcgaaggcagtcgctgagggtatacccaagctgcggatcgaggagtgcgccgcgaggaggcaggctcgcattgactctggaagcgaagtaatagttggagtcaacaaataccaactggagaaagaggatgccgtggaagtcctcgccatcgacaatacatccgttcggaatcggcagattgagaaactgaaaaagatcaagagtagtagggaccaggctttagcggaacggtgcttggctgcgctgaccgagtgcgcggccagtggtgatggtaacatcctggcactggccgtggacgcgtcacgcgctaggtgtacagttggcgagattaccgacgcgctaaaaaaagtgttcggagagcataaagctaacgatcgaatggtgtccggagcctatagacaggagttcggtgaaagcaaggaaataacatctgctattaagcgggtgcataaatttatggagagagagggtaggcgccctaggcttctggttgctaaaatggggcaggacggccacgacaggggggccaaagtaatcgcgaccggttttgctgacctcggtttcgacgtcgacattgggccactcttccagactccacgggaggtggcacagcaggctgtggatgccgacgttcacgccgtaggggtctccacccttgccgcaggccataaaacgctggtgcctgaactgattaaggaattgaacagcttgggaagaccagacatcctcgtgatgtgtggcggagtgattccacctcaggactatgagttcctcttcgaggtcggcgtcagcaacgtcttcggtccaggaactcgcatcccaaaggcagcagtccaggtgctggatgatattgagaaatgtcttgagaagaagcagcaaagtgta

SEQ ID NO: 33 - DNA, 2250 bp, Artificial Sequence
  Codon optimized sequence that encodes an MCM polypeptide with the I671V mutation
atgttacgcgctaaaaaccagctctttctcctgagtcctcattacctcagacaagtaaaagagagctctggatccagattgattcagcagaggttgctccatcagcagcagcctctgcacccagaatgggcagctctcgcaaagaaacaactgaagggcaaaaaccctgaagacctcatctggcatacaccagaaggcatttcaatcaagcctctgtatagtaagcgcgatacaatggacctacccgaggagctacccggtgtgaaaccattcacgcggggtccataccccacgatgtatactttcaggccttggaccatccggcaatacgcaggcttctctaccgtcgaagagagcaataagttctacaaagataacattaaggcaggacagcagggcctgtcggtggccttcgacctggctacccacagaggctatgactccgataacccgcgggtgcgcggggacgtcggtatggcgggagtggccattgacaccgtggaggatactaagatcctcttcgacgggattcccctcgaaaaaatgtcagtgtcaatgacaatgaatggagcagtcataccagtcctggctaatttcattgtgactggtgaggaacagggtgtgcccaaggagaagctgaccggtactatccagaatgacattctgaaagaattcatggtaaggaatacatacattttccccccggagccatccatgaagattatagccgatattttcgaatacacggctaagcatatgcccaagtttaacagcatctcgattagtggttatcatatgcaggaagctggggccgatgccatcttggaactggcttacactctcgccgacggtctggagtacagccgtaccggcctgcaggcaggcctcacaatagacgaatttgctccccggctgtccttcttctggggcatcgggatgaatttctacatggaaattgcgaagatgagagccggtaggaggctttgggctcatctgattgagaagatgttccagccaaagaacagtaagagcctgctgctccgggctcactgccagacttccggttggagtcttacggagcaggatccttacaataacatagtccgtaccgcaatcgaggcgatggctgccgtcttcggcggtacacaaagtctccacactaatagcttcgatgaggcacttggcctacccacggtaaagtcagctaggatcgcacgcaatactcaaatcattatccaagaggagtctggaattccaaaagttgccgacccatggggaggctcctacatgatggagtgcctgaccaacgacgtctacgatgccgcgctgaagcttatcaacgagattgaggagatggggggcatggctaaggcggtggcagagggaattcctaagctgaggatcgaagagtgtgccgcccgcaggcaggcgcgcatcgattccgggtccgaggtgattgtgggagtgaacaagtaccagctggaaaaggaggacgccgtggaggtactggctatcgataacactagcgtgcgtaaccgtcagattgagaagctgaagaaaattaaatcctcgcgtgatcaagcccttgcagaaaggtgtctcgctgccttgacagagtgcgcagcttccggagacggaaatatccttgctcttgccgtggacgcgtcaagggcaagatgcacagtaggcgagatcacggacgcactgaaaaaggtgtttggggaacacaaggctaacgacaggatggtgagcggcgcctaccgacaggagttcggagagtccaaggaaatcacgagtgccatcaagcgggttcacaaatttatggaacgggaggggagaaggcccagactgctagtggccaagatgggccaggatggacatgatcgaggagctaaagtcatcgcaaccgggttcgcagacctcgggttcgacgtagacattgggcctctgttccagacccccagagaagtggcccagcaggcggtcgatgcagacgtacacgctgttggagtttcaacactggcggctggacacaagaccttggtgccggaactcatcaaagagctgaatagcctggggcgacccgatatcctagtcatgtgcgggggggtgatcccgccccaggattatgaattcctcttcgaggtgggcgtttccaatgtgttcgggcctggcacgagaattcctaaggccgctgtccaggttctcgacgacatcgaaaagtgcctcgaaaagaagcaacagagcgtg

SEQ ID NO: 34 - DNA, 2250 bp, Artificial Sequence
  Codon optimized sequence that encodes an MCM polypeptide with the I671V mutation
atgctgcgtgcgaagaatcagctgtttctgttgtccccacattacctccgccaagtgaaagaatcgagcggttcacggctcattcagcagagactcctgcatcagcagcagccgctacaccccgaatgggctgccctggcgaaaaagcaactgaaaggcaaaaaccctgaggatcttatttggcatacacctgagggaattagcattaagccattgtactctaaacgcgacacaatggatctcccagaagagctacctggcgtcaagccgtttacccgcgggccctaccccacgatgtacacttttagaccatggacgattcgccagtatgctggtttctcaactgtcgaggagtcgaacaaattctataaggataacattaaagccggacagcaagggctctctgtggcctttgacctagcaacccatcgcggatatgacagcgacaaccccagagttaggggagacgtgggaatggccggcgtggcgatcgatactgtagaggacacaaagattctttttgacggcatacctctggagaaaatgagtgtgtccatgacaatgaatggcgcagttatacccgtgctcgccaacttcatagtcacgggcgaagaacagggtgtacccaaagagaaactcaccgggactatacagaatgatatccttaaggagtttatggtgcgcaacacgtacatctttccccctgagccttcgatgaagattatcgcagatatcttcgaatacactgcaaagcacatgccaaagttcaattccatttcaatctccgggtatcatatgcaggaagctggggcagacgccatcctggaattggcctatactttggccgatgggctcgagtattcccggaccgggttgcaagccggcctgaccatcgacgaattcgctccgaggctttccttcttctgggggatcggcatgaatttttacatggagatagccaaaatgcgtgccggtcgccgcctgtgggcccatctgatcgagaagatgttccagcctaaaaatagtaagagtcttctgctgagggcacactgtcagacatctggctggtctctaactgagcaagatccatacaacaacatcgtgcggaccgctatcgaggcgatggcagccgtcttcgggggtacccagagcctgcacaccaattcctttgacgaggctttagggctcccaacagtgaagtcagcccgtatagcacggaacactcagatcatcatccaggaagagtccggaattcctaaggttgccgacccctggggcgggtcctacatgatggaatgcctgaccaatgatgtgtacgatgctgccctgaaactaatcaacgagatagaagaaatgggagggatggccaaagccgtggccgagggtattccaaaactccgaatagaagagtgcgcagccaggcgtcaagcccggattgatagcggctctgaggtaatcgtgggcgtgaataagtaccagttggagaaggaggacgccgtcgaagtcctggctatcgacaacacgtcagtcagaaaccggcaaatcgaaaaactcaagaaaatcaagtcttcgcgggaccaggccctcgcagagcgctgcttagcagcccttaccgagtgtgcagctagtggagatggaaacatcctggctctcgcagtggatgcatcaagggcaagatgtacagttggagaaattaccgacgcactgaaaaaagtattcggcgagcataaagcaaatgacaggatggtgagcggggcttatcggcaagagtttggcgaaagtaaggagatcacctctgccatcaagcgcgtccacaagttcatggagagagagggacgcaggccaagactgctcgttgcaaaaatgggccaggacggccacgatagaggtgcgaaagttatcgccaccggtttcgccgaccttggctttgatgtcgatatcggaccactctttcagacacctagagaggtggcccaacaggccgtggatgctgatgtccacgctgttggcgtttccactctggctgcgggacacaaaaccctggtccctgaactgattaaggagctgaatagcctgggccggcctgatattcttgttatgtgtggtggcgtcattccgccacaggactacgaattcctttttgaagtcggcgtaagcaacgttttcgggcccggaacgcggattcccaaggccgctgtccaggttctggacgacatcgagaaatgtctggagaagaaacagcagagcgtg

SEQ ID NO: 35 - DNA, 2250 bp, Artificial Sequence
  Codon optimized sequence that encodes an MCM polypeptide with the I671V mutation
atgctgagggctaaaaatcagctctttctgttatcaccacactacctcagacaggttaaggagtcgtctggcagccggctcatacagcagaggctgctgcaccaacagcaaccgctgcatccagagtgggctgcattggccaagaagcagctcaagggtaagaaccctgaggatctgatttggcatacaccagagggtatcagcatcaagccgttatactctaagagggatacgatggacctgcctgaggagctgcctggagtcaaaccattcaccagaggcccttaccccactatgtatacattcaggccgtggactataaggcagtacgccggcttcagtacagttgaagaatccaataagttttataaagataatattaaggccggccaacaggggctgtccgtggcctttgatctggctacccataggggatatgactcagacaaccctcgggtccgcggagatgtaggcatggctggcgtcgcaatcgacactgtagaggacaccaagattctcttcgacggtatccctcttgaaaagatgagcgtaagcatgacaatgaacggggcagttattccagtgctggccaacttcatcgtcacaggagaagaacagggagtccctaaagaaaagctgacaggcaccatccagaacgatattcttaaagagttcatggtccgcaacacatatatcttcccacccgaaccttcaatgaaaattatcgcggacatatttgagtatactgccaaacatatgcctaaatttaactccattagcatcagtgggtaccatatgcaggaggcaggagcagacgctattttagaactggcttatacgcttgcagacgggctcgaatacagtaggaccggacttcaggccgggctgaccattgacgaatttgctcctaggctgtctttcttttgggggattgggatgaatttctatatggagatagcgaaaatgcgagcggggcgccggctgtgggcgcatctcatcgaaaagatgttccagccgaagaacagcaagtccttgttgctgagggcgcattgccaaacatccggatggtctctgactgaacaggatccctataacaacatagtgaggaccgccatcgaagccatggctgccgtttttgggggcacacaaagcctccacacaaactcgttcgatgaagctctagggcttcccacagttaagtccgctaggatcgcgcgcaacactcagattataatccaggaggagtccggtattcctaaggtggcagacccgtgggggggctcatatatgatggaatgcctaaccaacgatgtgtacgacgccgcccttaagctgattaatgagattgaagagatgggagggatggctaaggcggtcgcagaaggcatcccaaagctgcggatcgaggagtgcgctgccagaagacaagcccggattgactccggttctgaagtgatcgtgggcgtgaacaaatatcagctagagaaggaggacgctgtggaagtgctcgcgattgacaacacttccgtgagaaacagacagatagaaaaacttaaaaaaataaagtcctcgcgggatcaagccctggccgaacggtgtctcgccgctctcaccgagtgcgcagcttccggcgacggaaacattcttgctctggctgtggatgcgtcaagagcgaggtgcactgtcggggagatcaccgatgcactgaagaaggtgtttggagaacacaaagcaaacgatcgaatggtgagcggagcctaccgacaagaattcggggaatccaaggagataacgtcagctatcaagagagtgcacaaattcatggaacgcgaggggaggcggccgaggctgctggtggccaaaatggggcaggacggccacgaccggggagctaaggtcatcgccacagggtttgccgacctaggcttcgatgtcgacatcggcccccttttccagactccccgggaagttgcacagcaggccgttgacgccgatgttcacgccgtcggagtgtcaaccctagccgccggccacaagaccctggtcccagagctgataaaagagctgaattcactcggccgaccagatatcctggtcatgtgcggcggggtgatccccccccaagactatgaatttctgttcgaggttggcgtttctaatgttttcggcccaggtacacggattcccaaggcggcagtccaagtactcgatgacatcgaaaagtgtcttgaaaagaagcagcagtcagtt

SEQ ID NO: 36 - DNA, 2250 bp, Artificial Sequence
  Codon optimized sequence that encodes an MCM polypeptide with the I671V mutation
atgctacgagccaagaaccagctcttcttgctaagtccgcattacctgaggcaagtgaaggagagcagtggcagccgacttatccagcagagactcctccaccaacagcagcccctccatcccgagtgggcagccctcgcgaagaaacaattaaaaggtaaaaacccggaggatctcatctggcatacacctgaaggcatttctatcaagcctctctactcaaaacgggacactatggacctgcctgaggaactcccaggtgtcaaaccattcacacgtgggccttaccctacaatgtacacctttagaccttggacaattagacagtacgctggattttctactgtagaggaaagtaataaattctataaagataacatcaaggccggtcagcaaggcctgtccgtcgccttcgacctggccacacacaggggctatgacagcgacaacccaagagtgagaggggatgttggcatggctggggtggctattgacactgtggaagacactaagatcttattcgacggcatcccacttgagaaaatgtcggtgtctatgactatgaacggcgctgttatccccgtgctggccaattttatcgtgacaggagaagagcaaggcgtcccgaaagaaaagctcacggggaccatccagaatgatattctcaaggagttcatggttcggaacacttatatctttccaccagaaccatccatgaagatcatcgccgatatttttgagtataccgctaaacatatgcccaaatttaacagcatctctatctcggggtatcatatgcaggaagctggcgcagatgctattctggagttggcgtacactctcgctgacggtctggagtattcaaggaccgggctccaggctggcctgactattgacgaattcgcaccccggctgagctttttctggggtatcggtatgaatttctacatggaaatcgccaagatgagggctgggcgcagactgtgggcacatctgattgagaagatgttccagcctaagaacagcaagtcactcttactgagggcccattgccagacctccggatggtccctaacagaacaggatccctataataatatcgtaagaaccgccatcgaagccatggctgccgtatttggcggtacgcagagcctgcacacaaactcgtttgacgaggccctgggcctaccgaccgtgaaatctgcgcggattgctaggaacacccaaatcattatccaggaggagagtggaatccccaaggtagcagacccctggggtggctcatatatgatggagtgtctgactaatgatgtgtacgatgctgcactcaagttgatcaatgagatcgaagagatgggcggaatggctaaggccgttgcagaagggattcctaaactgcgcatcgaagagtgtgcagccagaagacaggcgcggattgactcgggctcagaagtcatcgtcggagtgaacaaataccagctggagaaggaggacgcggtagaagtcttggcaatcgacaatacgagcgtgcgcaatcggcagatagaaaagctaaagaaaatcaaatcatcaagggaccaggccctggccgagagatgcttggcagcattgactgaatgcgccgcgagcggtgatgggaatatactcgccctggccgtcgatgcatctagagcgcggtgcacagtcggggaaataactgatgctctgaaaaaggtgttcggcgaacacaaagccaatgacagaatggtgtctggcgcctaccgtcaagaattcggagagagcaaggaaattacctccgcaattaagcgcgtacacaagtttatggaaagggaagggcgccggccccgtctgctcgtggctaaaatgggacaagatggtcatgacagaggggctaaggtgattgctactgggttcgcagacctcggcttcgatgtggacatcggcccactatttcaaaccccgcgggaagtagcacaacaggcagtggatgctgacgtacacgctgtgggggtgagtaccctggccgccggccataagacgcttgtcccggagctaatcaaggaacttaactccttgggtcggccagatatattggtgatgtgtggtggtgtgattcccccacaggactatgagtttctgtttgaggtgggagtgagcaatgtctttggacccggtacacgcatccctaaagccgccgtccaggtcttagatgacattgaaaagtgccttgagaagaaacaacagtcggtc

SEQ ID NO: 37 - DNA, 2250 bp, Artificial Sequence
  Codon optimized sequence that encodes an MCM polypeptide with the I671V mutation
atgctcagggcgaaaaaccaactatttttgctctcaccccattacctccgacaggttaaggaaagtagtgggagcagactcatccagcagcggttgctgcaccagcagcagccactgcaccccgagtgggccgcattggccaaaaagcaattgaagggcaaaaaccccgaggacttaatttggcacaccccagaaggaataagcatcaaacctctgtactcaaagcgtgacaccatggatttgcctgaggagctacctggggtgaagcccttcacaagagggccataccctaccatgtatactttcagaccctggactatcagacagtacgccggcttttcgaccgtcgaggagtccaataagttttacaaagataatatcaaggctggtcagcagggtcttagtgtggccttcgatttggctacccaccgggggtacgacagcgacaacccacgcgtccgcggagatgtaggtatggctggagtggctattgataccgtcgaggataccaaaatattgttcgacggtataccgctggaaaagatgagtgtgagcatgacaatgaacggagctgtcatccctgtgctcgccaacttcattgtgacaggcgaggagcaaggtgtgccaaaggaaaaactgacagggacaatacagaacgacatcctgaaagagttcatggtccggaatacctacatctttccacccgaaccttctatgaagattattgccgacattttcgaatacaccgctaagcatatgcccaagtttaattctatctctataagcggctaccacatgcaggaagccggagcggatgccatccttgagttagcctatacattggccgatggcctggaatactcccgaacaggcctacaggcagggctaacaatcgacgaatttgcgcctcgactgtcctttttctgggggatcggcatgaacttctacatggagatcgctaagatgagagccgggcgccgactgtgggctcacctgatcgagaagatgttccagccaaaaaactccaaatctttgctgctgcgcgcccactgccaaacttccggctggtccctgaccgaacaggatccctataacaacatcgtgcgaactgcaattgaagccatggccgcggtgttcgggggcacgcaatctctccataccaatagtttcgacgaagccttgggactcccgactgtcaagtccgccagaatagccagaaatacccaaatcatcatccaggaggaatctggaattcctaaggtggcggatccctggggtgggtcctacatgatggagtgcctgaccaacgacgtgtacgacgccgccctgaagttgattaacgaaattgaagagatgggcggcatggcaaaagccgtagccgaaggcatccccaagttgagaatcgaggaatgtgccgccaggcgccaggcacgcatagatagtggaagtgaggtcattgtcggtgtaaacaagtaccagctggagaaagaggatgcagttgaggtgcttgcgatagacaacacaagcgtgaggaataggcagatcgagaaactgaagaagatcaaatctagccgggatcaggccttagccgaacgctgtctggccgccctgacagagtgcgccgcatctggggacgggaacatcttggccctggcagttgatgccagccgggcccggtgtacggtgggcgagataaccgacgccctgaaaaaggtgtttggggaacataaggcgaatgacaggatggtctcaggggcgtacagacaggaattcggagaaagcaaggagatcacctccgccattaagcgcgtgcataaattcatggagagagaagggcggcggccgagattgctggtagctaagatgggacaggatggacatgatcggggagccaaggtgatagccacaggctttgcagatctgggctttgacgtggacattggccccctgttccagaccccacgtgaagttgcacaacaggccgtcgacgccgatgtccatgccgtcggcgtgagcaccctggcggctggacataaaacattagtccccgagctcatcaaagaactgaattccctcgggcggccagacatcctcgtgatgtgtgggggcgtgatacctcctcaggattatgagtttctgttcgaggtaggtgtctccaatgtcttcggtccagggactcgcattccgaaggctgctgtccaggtccttgacgacattgaaaagtgtctagagaaaaagcaacagtctgtg

SEQ ID NO: 38 - DNA, 2250 bp, Artificial Sequence
  Codon optimized sequence that encodes an MCM polypeptide with the I671V mutation
atgcttcgcgccaaaaaccaactttttctgctgtctccccactacttgcggcaagtaaaggagagcagcggctcccggctgattcaacagcgattactacaccagcagcagcccttgcatccggaatgggcagccttagcaaaaaagcagttaaaagggaagaaccctgaagacctaatctggcatacacctgaaggaatctcgattaagcctctttattccaagcgggacactatggatttgccagaagaactccctggcgtgaagccgttcacgcgcgggccttatcccacgatgtacaccttccggccatggacaatccgacaatatgccggcttcagcacggtggaagagtccaacaagttctacaaggataacatcaaagccggccagcagggactgagcgtggcattcgacctggccactcaccggggatatgactctgataaccctagagtaagaggcgacgtcggcatggcaggcgtcgccatagatactgttgaagacactaagatcttgtttgatgggataccactggagaaaatgtctgtgagtatgaccatgaacggcgccgttattcctgtcctcgctaacttcatagttacaggagaggaacagggcgtccccaaagagaagcttaccggaaccatccagaacgatattcttaaagagtttatggtgcggaatacgtacatttttccccctgaacctagcatgaaaatcatcgcagacatctttgagtatacagctaagcacatgcctaagttcaattctatcagtatttcgggctaccacatgcaggaggctggggcagatgccatcctggagctggcctatactttagctgacggtttagaatactcgcgcactggcctccaggcgggcctcacgatcgacgagttcgccccaaggctctcatttttttggggcattggcatgaacttctacatggagatcgcgaagatgcgggctggccgccgcctgtgggcacatctcatcgagaagatgtttcagcctaaaaatagcaaaagcctccttttgcgggcccactgccaaacatccggatggtcgctgacagaacaggacccatacaacaacatcgtccggacagctatcgaagccatggccgccgtgttcggaggaactcagagcctccacacgaattcatttgacgaggccttggggctccccacagtgaagagcgccagaatcgctcggaacacccagattatcattcaagaggagagcgggatacccaaggtggccgatccgtggggtggcagctacatgatggagtgcctgacaaacgacgtttacgacgccgccctcaagctgataaacgagatcgaggagatggggggtatggcaaaggccgtcgctgaggggattcccaaactgaggatcgaagaatgcgcagctcggcgacaggctcgaattgacagcggttctgaggtgatcgttggagtgaataaatatcagctggagaaggaagacgcagtagaggtcctggccatcgataacacaagtgtgagaaatcgacagatagagaagttgaagaaaattaagtcatctagagaccaggctctcgcagaacggtgtctcgcagcactcacagaatgtgcagcaagtggggacggtaatatcctggccctcgcagttgacgcgtctcgcgctaggtgtaccgtgggcgagatcaccgatgctcttaaaaaagtgttcggggagcacaaagcgaacgataggatggtttccggcgcttacaggcaggaatttggagagagcaaggaaatcacatctgctattaaacgagtgcacaaattcatggagcgggaaggcagaaggccacgcttgctagtcgccaagatgggtcaagatggacatgaccgcggcgccaaggtaatagctaccgggtttgccgatttgggcttcgatgtggacatcgggcctctgttccagacacctagagaggtggcccagcaggctgtcgatgccgatgtccatgcagtaggagtatcgaccctcgcggcggggcataagacactggtgcctgagctgatcaaagagttgaactctctcggaaggccagacatactggtcatgtgcggtggagtcattccaccccaggactacgaatttctgttcgaggtgggcgtttccaatgtctttggccccggcactcgcatccccaaagctgccgtgcaagtcctggatgacatagagaaatgtctggagaagaaacagcaatccgtc

SEQ ID NO: 39 - DNA, 2250 bp, Artificial Sequence
  Codon optimized sequence that encodes an MCM polypeptide with the I671V mutation
atgcttagagcgaagaaccagcttttcctgctgtctccccattatctcagacaagtaaaagagtcttccggtagccggctgatccagcaaaggttattacaccagcaacagccacttcaccccgagtgggcggccttagccaagaagcagctcaaaggcaaaaatcctgaggacctaatttggcacaccccagagggcatctccattaagcctttgtactcgaagcgcgacacaatggatttgcctgaggaattacctggggttaagccttttaccaggggaccctatcccacgatgtacacattccgaccttggacaattcgccaatatgctgggttcagtacagtggaggaaagcaacaagttttacaaagacaacataaaagccggtcaacagggcctgtctgtcgcattcgatcttgccactcaccgcggctacgactctgataacccgagagtccgcggggatgtgggcatggcaggagttgctatcgacacagtcgaagacaccaagattctgtttgacggtataccactggagaagatgtcagtttcaatgactatgaatggcgcggtgatccctgttctagcaaactttatagtgactggggaggagcagggggtgccgaaggaaaagttaactggaactattcagaacgacatccttaaagaattcatggtgcgaaacacgtacatcttccccccggagcccagcatgaagataatcgcagacatctttgaatacaccgcgaagcacatgcccaagttcaactcaattagcatctcagggtaccatatgcaggaagcgggggccgatgccatcctcgaactggcttacacgcttgcggatggcctagagtatagtagaaccggattacaagctggcctcacaatagatgaatttgcccctcgtctcagttttttctggggcatcggaatgaacttttatatggagattgctaagatgcgggcaggccgccgtctctgggcccacctgattgagaaaatgtttcagcccaagaactccaaatcactgctgttaagggcccattgccagaccagcggctggtccctgaccgaacaggacccctacaataatattgtgcgcactgccatcgaggccatggcagcagtgttcggtgggacacagagccttcataccaacagttttgatgaggccctggggttacctaccgtcaagtccgcgcgcatcgcccgcaacacccaaatcattatccaagaagagtccggaatacccaaggtcgcagacccatggggggggtcctacatgatggagtgccttaccaatgacgtgtatgatgctgccctaaaacttattaatgagatcgaagaaatgggaggaatggctaaggcagtcgcggaaggaattcctaaactcagaattgaagaatgtgctgccagacggcaagcacgtatagattctgggtccgaggtaatcgtcggggtcaacaagtaccagcttgaaaaggaggatgctgtggaggtcctggccattgacaacacgagtgtgcggaatcgacagattgagaagctgaagaaaattaagagctcacgagaccaggctctggcggagcgctgcctggcagcactgaccgagtgtgctgcttcaggtgatggtaatatccttgccctagccgtggacgccagtcgcgcccgatgcacagtgggggagattaccgacgccctcaaaaaggttttcggagaacacaaagccaacgatcgcatggtgtcaggagcttaccgacaggagtttggtgagagtaaagaaattacatccgctatcaaacgagtgcataaattcatggagagagagggtagacggcctagactcctggtggccaagatgggacaggacggtcacgatcgtggtgctaaggttatcgccacaggcttcgctgatctgggattcgatgtagatatcggccctctgttccaaactcctcgggaagtggcacaacaggctgtcgatgctgatgtccatgcagttggagtaagcacacttgcagctggacataagacactcgtgcctgagctgatcaaggaactgaacagcctggggaggccggacattttggtcatgtgcgggggggtcatccccccccaggactatgaattcttgtttgaggtgggagtgtcaaacgtcttcggtcccggcacacggatccccaaggctgcagtgcaggtgcttgatgatatcgagaagtgcctcgagaagaagcagcaatccgtt

SEQ ID NO: 40 - DNA, 2250 bp, Artificial Sequence
  Codon optimized sequence that encodes an MCM polypeptide with the I671V mutation
atgctgagggctaaaaaccaattgttccttctgagccctcactatcttcggcaggtcaaagaaagctcaggctcacgcctcattcagcagcggctgctccaccagcagcagccactgcatccagagtgggctgcattagcaaagaagcaactcaaaggcaagaaccctgaagacttaatctggcatacccccgaggggatcagcatcaaacccttatattcaaagcgggatactatggacttgccggaagagttacccggcgtcaaaccctttacgcgcggcccataccctacaatgtacaccttccggccctggaccatccgccagtatgccgggtttagcaccgtcgaggaatctaataagttttataaggataacattaaagctgggcaacaaggactgtcagtcgcttttgatttggccacacatagaggatacgattctgataacccacgggtgaggggtgacgtggggatggccggagtggctatcgataccgttgaggacacaaagatcctttttgacggcattcctctcgagaaaatgtctgtcagtatgaccatgaatggggccgtcatccccgtgcttgccaacttcatagttacgggagaggagcagggagtgccgaaagagaaactgaccgggactatccagaacgacattctgaaggaattcatggtgcggaatacctacatattcccccccgagccaagcatgaagatcattgccgacatcttcgagtatactgctaaacacatgcccaagtttaattccatcagtatcagtggctatcacatgcaggaggcaggagcggacgccatcttggaattggcatacactctggcggatggtctcgagtattcacggactggactgcaggctggcctgaccatcgacgaatttgcgccgcgcttatcgttcttctggggcatcggaatgaatttctatatggaaatcgccaaaatgagggccggtagacgcctgtgggcccatttgattgaaaaaatgttccagcccaagaattccaagtccctattactaagggctcattgtcaaacatctggatggagtttaacggagcaggacccatacaacaatatagtgcgcacagctattgaggcaatggcagccgtgttcggaggcactcaatcactgcatacaaatagtttcgatgaagctctggggctccccaccgtgaagagcgccagaattgcccgaaacacccagatcatcatccaggaagagtctggcatcccaaaggtagctgacccctggggcggcagctacatgatggaatgcctgactaacgatgtctatgacgctgctctgaagctgattaacgaaattgaagagatgggcgggatggccaaagcggtggcagagggcatccctaagctccggattgaggaatgtgctgcacgcagacaggcccggattgactccgggagcgaggttatcgttggtgtaaataaataccaactcgagaaagaggatgccgttgaagtactcgcaatcgacaacacctcagtgcggaataggcagatcgagaagctgaaaaagatcaaaagctctagggaccaggccctggctgagcgttgtctcgcagctttaacagagtgtgccgcttcaggtgatggtaatatccttgcccttgccgttgacgcatcgagagctagatgcacagtgggtgagattactgatgccctaaagaaagtatttggtgagcataaagccaatgataggatggtctccggagcatacagacaggaatttggcgagtcaaaggagattacctcagccatcaaacgcgtccataaattcatggagagagaaggaaggaggccacggttgctagtggcaaagatgggccaggacggccatgataggggagctaaggtcattgcaaccggctttgccgacttgggcttcgacgtggacatcggccctctatttcagactccacgggaggtggcacagcaggctgtggatgcggatgtgcacgccgtgggggtgtctaccctggctgccgggcacaagactctggtgcctgagcttattaaagagttgaacagcctgggccgacccgacatactcgtgatgtgcggcggtgtcataccgcctcaggattatgaatttctgtttgaagtgggcgtgagcaatgtgtttggacctggtacacgcatcccaaaggctgctgtgcaggtgttagatgatatcgaaaagtgtctggaaaaaaagcagcagagcgtc

SEQ ID NO: 41 - DNA, 2250 bp, Artificial Sequence
  Codon optimized sequence that encodes an MCM polypeptide with the I671V mutation
atgctgcgtgcgaaaaaccagcttttcctgttgagtccacactacctgagacaagtcaaagaatcaagcggttccaggttgattcagcagcggttgctccaccagcagcagccactccacccagagtgggcagcactggcaaagaagcagttgaaaggtaaaaaccctgaagacctgatttggcacactcctgaaggcatttcaatcaaacctctgtacagcaagcgcgacacgatggatcttcccgaagaactccccggtgtcaaaccatttactagaggcccctaccctacaatgtatacctttcggccatggactatccgacagtacgctggattttccaccgtcgaggaaagtaacaagttctataaggataacattaaggccggccagcagggactgtcggtagcctttgacctcgcaacccatcggggctacgatagcgataacccaagagtgaggggagatgtgggcatggccggtgtggcgattgatactgtggaagacactaagatactgttcgatgggattcctctcgagaaaatgtcagtctccatgaccatgaacggggctgtcatacccgtgcttgctaactttattgtgacaggcgaagagcagggagtgcctaaggagaaactgaccggcacaattcagaacgacatccttaaggaattcatggttagaaatacgtacatctttcctcccgagcctagtatgaaaattatagcggacatctttgaatatactgccaaacacatgccaaagtttaatagcatatccatatcaggatatcatatgcaggaagcaggtgcggatgctatccttgagctggcatacaccctggctgatggtctcgaatattctagaacgggattacaggccggtctcacaattgatgaatttgcaccaagattaagctttttttggggaattgggatgaatttttacatggaaatagctaaaatgcgcgcgggacgccgcctctgggcccaccttatcgagaaaatgttccagccgaagaatagtaagagtctcctcctgagagcccactgccagactagcggatggagcctgactgaacaggacccctacaataacatcgtccggacagccattgaggccatggcggcagtcttcggtggaactcagtcgctgcacacaaattctttcgatgaagccctcggcctaccaactgtgaaatctgccagaattgccaggaacacccagatcattattcaagaggagagtgggattcctaaggtcgccgacccctggggcgggtcatatatgatggaatgtctcaccaatgacgtgtacgacgccgcactcaagttgataaacgagattgaggagatgggcggcatggctaaggctgtggccgagggcattcctaaactcagaatcgaggagtgtgccgcccggcgacaggcgcgtatagacagcgggagtgaggtcattgttggagtcaacaaatatcaactagagaaggaagacgcggtggaggtgctggctatcgacaatacctcagtgcggaatcggcagatcgagaagctcaagaagattaagtcttcaagggaccaggccctggctgagcgctgcctggctgccctgaccgaatgcgccgccagtggggatgggaacattttggctttagcggtcgacgcttccagggcccgttgtaccgtaggggagattactgatgcattgaaaaaagtgtttggtgaacataaagccaacgatcggatggttagtggggcttataggcaagaatttggagaatccaaggagatcaccagtgccataaaaagagtgcacaaattcatggaacgcgagggccggcggcctcggctcctggttgcaaagatggggcaggacggccatgaccggggggccaaagtgatcgccaccggatttgcggatctcgggtttgacgtggacattggcccgctattccagacgcctcgtgaagtagcacagcaggccgtggacgccgatgtccatgctgtgggagtgtcaacactggctgccgggcacaaaacactggttccagagttgatcaaggaactgaattctcttggtcggcctgatattcttgtaatgtgcggcggagtcatcccaccgcaggactacgagttcctttttgaggtgggggtatcaaacgtgtttggacctggaacgcgcattccaaaggctgccgtgcaggtgcttgatgatatcgaaaagtgcctggaaaaaaagcagcagtccgtg

SEQ ID NO: 42 - DNA, 2250 bp, Artificial Sequence
  Codon optimized sequence that encodes an MCM polypeptide with the I671V mutation
atgcttagagcaaagaatcagttattcctgctgagtccccattacctgcgacaggtgaaggaaagctcaggcagcagactgatccagcagcgcctgctgcaccaacagcagcctctgcatccagagtgggccgctctcgccaagaagcagcttaagggaaaaaaccctgaagatctgatttggcacacacccgaaggtatctcaataaaacccttgtattctaagcgcgatacaatggacttgccagaagaactgcctggagtgaaaccctttacaagggggccctacccaacaatgtatacatttaggccttggacaattagacagtacgcgggttttagcactgtcgaggagtccaacaaattctacaaggataacatcaaagcgggccagcaaggactgtcagtggcatttgacttggccactcatagggggtatgacagtgataaccctcgggtgcgaggtgacgtgggaatggccggggtcgcgatcgatacagtggaagacaccaaaatcctcttcgatgggatacccctggagaagatgtccgtttcgatgacgatgaacggggccgtgatcccagttctcgctaacttcattgtaactggcgaggaacagggagttcccaaagagaaactgaccggcactattcagaacgatatcctaaaggaattcatggtgcggaatacctacattttccctccagagccctctatgaagattatagcagatatcttcgagtataccgccaaacacatgccaaaatttaattccatttccatctctggctaccacatgcaggaggccggcgcagacgccatcctcgagcttgcctacactttggcagatgggttagaatactcacggacaggactacaggctggtctgacaattgatgaattcgcccctcgcctgtcattcttttgggggataggcatgaatttctacatggagatcgccaagatgcgcgccggcagaagactgtgggcacatctcatcgaaaagatgttccagcctaaaaactccaagagcctgttattaagagctcactgccagacctccgggtggagtctgactgagcaggatccttacaacaatatcgtcagaacagcaatcgaggcaatggccgccgtttttggggggacgcagtccttgcatacaaattctttcgatgaagctctcggactgcctaccgtcaaatccgcgagaatcgcgcggaacacccaaatcataattcaggaggaatccggaattcccaaagtggcggacccatggggagggagttacatgatggaatgcctcaccaatgatgtgtatgatgcagcactcaagctgattaatgaaatcgaggaaatgggaggtatggcaaaagctgtcgcagagggcatccccaagctgagaatcgaagaatgcgccgccaggaggcaggccagaattgattctgggagtgaggtgatcgtgggggtgaacaagtaccagcttgagaaggaagacgcagttgaggttctcgccattgataatacctcagtgcgcaaccggcagattgagaaactcaagaagattaagagctccagggaccaggcacttgctgagcgttgcctcgcggcactgacagagtgcgctgcaagcggggatggtaacatcctcgctctggccgtcgacgcaagcagagctcggtgcacggttggagagatcaccgacgccctgaagaaagtgttcggcgagcacaaggccaacgacagaatggtgtcgggggcgtaccgccaggaatttggtgagtccaaggagatcacaagtgccatcaaaagggtgcataaatttatggagagagagggacgacggcctcgccttcttgtggcgaaaatgggacaggatggccacgatcggggtgctaaggtgatcgcgacgggctttgccgaccttggctttgacgtggacattggacccctttttcaaacacctcgagaagtggcacagcaggctgtggatgcagacgtgcatgccgtgggggtctcaacactggctgccggccacaagactctggtccccgagctgattaaagagctgaattccctggggagaccagacatcctcgttatgtgtgggggcgtgattcctcctcaagactacgagttcctctttgaggttggcgtttcaaacgttttcgggcccggcacacggatacctaaagcagctgtccaggtgctagacgatattgagaagtgtcttgaaaagaagcaacagtctgtc

SEQ ID NO: 43 - DNA, 2250 bp, Artificial Sequence
  Codon optimized sequence that encodes an MCM polypeptide with the I671V mutation
atgcttcgcgctaagaatcagttgtttctgctgtcacctcactatctaagacaagtcaaagagtcatccggctctagattaatccaacaacggctgttgcaccagcagcaacctttgcaccctgaatgggccgccttggctaaaaagcagctaaaggggaaaaatccagaagacctgatttggcatacaccagagggtataagtattaagccactgtattctaagcgcgacaccatggacctccccgaggagttaccaggggtgaagcctttcaccagagggccctaccccaccatgtacacctttaggccttggactattcgacagtatgcagggtttagcaccgttgaagagtctaataagttctacaaagacaacatcaaagccgggcagcaaggcctttctgtggctttcgacctggcaacacatcgcggctacgattctgataacccgcgtgtgaggggcgatgttgggatggctggcgtcgctatcgacacggtcgaggacacaaagatcttatttgatggaatccctcttgaaaagatgagtgtcagcatgaccatgaacggcgctgtgatcccagtactggctaactttattgtgacaggggaggaacaaggggtgccgaaagagaaactcacaggaactattcagaacgatatcttaaaagagtttatggtgcggaacacttatattttcccccccgaacctagcatgaaaataattgccgacattttcgagtatactgctaagcatatgcctaaattcaactctattagtatcagcgggtatcacatgcaggaggccggggcggatgccatactggagctggcctacaccctagccgacggactggaatattcacgtactggcctgcaggctggacttaccatcgacgaatttgcaccccgactgagtttcttctggggaatagggatgaatttttatatggagattgctaagatgagagctggacgcaggctctgggcccacctgatcgagaagatgtttcaacctaaaaactccaagagcttgctattgcgagcccactgtcaaacctcagggtggagtctgactgaacaggacccttataacaatattgtgaggaccgccatcgaggcaatggcagctgtattcggcggaacccagagcctgcacacaaactctttcgacgaagctctgggcctgccaaccgtcaaatccgccaggatagccaggaacacccagattattatccaagaagaatctggtatccccaaggtcgccgatccttggggcggctcttacatgatggagtgcttaaccaacgatgtgtacgatgcagctttgaaactcatcaacgaaatcgaagaaatgggggggatggcaaaagcggtcgcagagggtattcccaagctgcggatcgaagagtgtgcggcaagacggcaggcacggattgacagcggttccgaggtgatagtcggcgtgaacaaataccagttagagaaagaagatgctgtcgaggttctggccatcgacaacacaagcgtgcgcaacagacaaatcgaaaaactaaaaaagataaaatcttccagagaccaggctctcgcggagcgctgcctggccgcgttgaccgagtgcgccgcctcgggcgacggaaatatcctggccctggccgtcgacgccagtagggcccggtgtacagtgggagagatcaccgatgcgctgaaaaaagtttttggggagcacaaagccaacgataggatggtgtccggggcgtatcgtcaggagttcggcgagagtaaagaaattacctctgccataaagcgggttcacaaatttatggaaagagaaggcaggaggcctagactgctcgtggccaaaatggggcaggacggccatgacaggggagccaaagttattgccactggctttgccgatttggggtttgatgtcgacataggccccctatttcagacccctagggaagtggctcaacaggccgtggatgccgacgtacacgctgtcggggtgtccaccctcgctgcaggccacaagacattagttcctgaactgatcaaagaactgaattcactaggccgccccgacattctggtgatgtgcggcggtgtgattccacctcaggactatgaattcctctttgaggtgggtgtctctaacgtgttcggaccaggtacccgaattcctaaagccgcagtgcaggtgctcgacgacattgagaagtgtcttgagaagaaacagcagtcagtg

SEQ ID NO: 44 - DNA, 2250 bp, Artificial Sequence
  Codon optimized sequence that encodes an MCM polypeptide with the I671V mutation
atgctgagagctaaaaatcaactgtttcttctgtcgccccattaccttcgtcaggtaaaggagagcagtggttcccggctaattcaacagagactgctgcaccaacagcaacccctgcaccctgagtgggcggccctggccaagaaacaattgaagggcaagaacccggaggacctcatatggcatacaccagagggtatctccatcaagcctctgtacagtaagcgcgatactatggatctgccagaagaactcccaggcgtgaaaccattcacaagagggccctaccccaccatgtacactttcaggccgtggacaataaggcaatatgcagggttttccacagtcgaggagagtaataagttctacaaggataatattaaagctggtcagcaggggctgtctgtggccttcgatttagctacgcatcggggatacgattctgataacccccgggtccggggcgacgtgggcatggccggggtggctatcgacactgtcgaagataccaaaatcttgttcgacgggattccactagaaaaaatgagcgtcagcatgacgatgaacggcgccgtcataccagtgctcgccaattttatcgtcactggtgaggaacagggggtcccaaaggagaaacttactgggacaatccagaatgacattttaaaggaatttatggtgcgtaacacctatatcttcccaccagagccatctatgaaaataatcgctgacatcttcgaatataccgccaagcatatgcccaagttcaacagtatttcaattagcggctatcacatgcaggaagcaggggccgatgccatactggaactcgcttatacccttgctgacgggctggaatacagtagaactggtctgcaggcaggcctcacaatcgatgaattcgcaccacgtctgtcatttttctggggcattggcatgaatttctacatggagatcgctaaaatgagggcagggcggagactgtgggcccatctgatcgagaaaatgtttcagccaaagaactccaaaagtttgctgctgcgcgcgcactgtcagacgagtggatggtccttgaccgagcaggacccctataataacatcgtgcgtacggctattgaagccatggcggccgtgtttggcggcacccaaagcctgcacactaatagtttcgatgaagccctgggcctgcccaccgtaaaaagcgcccgaatcgcccggaacacacagattatcatccaggaggaaagtggaatccctaaagtggcagatccatggggcggcagctacatgatggaatgcctgacaaacgacgtgtatgacgctgccttaaagctcatcaatgagatcgaggagatgggaggcatggctaaagccgtggctgagggcatccctaagctgcggattgaagagtgtgccgcgcggcgacaggccaggattgatagcggaagtgaagttatcgtgggtgtgaacaaatatcagcttgagaaagaggacgccgtagaggtcctggccatcgacaataccagtgtgcgcaataggcaaattgagaaactgaagaagattaagtctagcagggatcaggccctggccgagcggtgcctggctgccctcaccgagtgcgcagcgagcggagatggtaatatactggctctggcggtggatgcctcgcgggcacgatgtacggtgggcgagatcacagatgcccttaaaaaggtgtttggcgaacataaagccaatgatagaatggtgtctggagcatatcgtcaggaattcggtgaaagcaaagagatcacaagtgcgatcaaacgagtgcataaatttatggaaagagaagggcgcagaccacgtctgctggtggctaaaatggggcaggatggccacgatcgaggagcaaaagttatcgccacaggttttgccgacctggggtttgatgtagacataggccccttgtttcagacacctagggaggtggcgcagcaggccgttgacgccgatgtgcatgctgtgggagtgtccacactcgcggccggccataagacgctcgtgcccgaactgattaaagagttgaacagcctggggaggccagacattctcgtgatgtgtggaggcgtgattcccccacaggattatgagtttctttttgaggtcggcgtgtctaatgtgttcggtcctggtacccggattcccaaggcagctgtgcaggtcctagacgatatcgaaaagtgcctggagaagaagcaacaaagcgtt

SEQ ID NO: 45 - DNA, 2250 bp, Artificial Sequence
  Codon optimized sequence that encodes an MCM polypeptide with the I671V mutation
atgttacgagccaagaaccagctgtttctgctttctccgcactacctcaggcaggtgaaggagagtagcggaagcagactgatacagcagagactcttacaccagcaacagcctctccaccctgaatgggccgccctcgcaaagaaacagctgaagggaaaaaatccagaggacctgatttggcacactcctgaagggatcagcattaaaccgttgtacagcaaacgtgacaccatggatttgccagaggaactgcctggagttaaaccttttacacgcggcccataccctactatgtatacgttcagaccatggacaatcagacagtatgccggtttctcaaccgtggaggagtccaacaagttctataaggataacataaaggccggacagcagggtttgtctgtagctttcgatctggctactcacagaggttatgacagcgacaatccacgcgttcgcggggacgtgggcatggctggggtcgcaatagataccgtcgaggatacaaagattctcttcgacgggatccctctggagaagatgtcagtgtccatgaccatgaacggtgctgttatccctgttcttgctaatttcattgtaaccggcgaagaacagggcgttccaaaggagaaactgaccggaactatccagaacgatatcctcaaagagttcatggtcaggaacacttacatcttcccgcctgaaccttctatgaagattattgccgatattttcgagtacactgcaaagcatatgcctaagttcaacagtatcagcatatccggctaccatatgcaagaggccggcgccgacgcaattctcgaactggcttacactttggctgacggcttagagtacagcaggactggtctccaagccgggctgacgattgatgaatttgcccctcggcttagttttttctggggcatcggcatgaatttctacatggagatagccaagatgagggccggcaggcggttgtgggcacatctcatcgagaaaatgttccaacccaagaatagcaagtccctcctacttcgagcccattgccaaacgagtggctggtcattaaccgagcaagatccttataataatatcgtgaggacagccattgaggcaatggcagcggtcttcggtggaacacagagtctgcacacgaacagctttgatgaagcccttggactgcctacggtcaaaagcgccaggatcgctcggaacacacagatcattatccaagaggaatctggcatccccaaggtggctgatccctggggaggctcttacatgatggaatgcctcacaaacgacgtctacgacgccgccctgaagttgatcaacgagatcgaggaaatgggggggatggctaaggcagtagccgagggaattcctaagcttagaatagaggaatgcgctgcccgacgccaggctcggatagacagtggttccgaggtcatcgtgggcgtgaacaaataccaactcgagaaggaggacgccgtcgaggttctggccatcgacaacacgtcagttcgtaaccgacaaatcgaaaaattaaaaaaaataaaatctagcagggaccaggctctggccgagcgttgccttgccgcactgactgagtgtgcagcctcaggcgacggaaacatactggcgcttgcagttgatgccagccgggctagatgtaccgttggggagatcacggacgctctcaaaaaagtgttcggcgagcacaaggcgaatgatcgaatggtgtccggcgcctatcgtcaggagtttggcgagtccaaggaaattacctcagcaatcaagagagttcacaaatttatggagcgcgaagggcgccggcctcggttgctcgtcgctaagatgggacaggacggccatgaccgtggcgccaaggtgattgcgactggctttgcagatctaggcttcgacgtagatataggcccactgttccagacgccccgagaagtggcgcagcaggccgtggacgccgacgtccacgctgtcggagtgagtaccttggcagccggccacaaaacactggtgccagagcttattaaggagctaaattccctggggcggccagacatcctcgttatgtgtggaggggtgataccgccccaagactatgagttcctgttcgaggtgggggtgagtaatgtcttcggccccggcacacgaattcccaaagcagcagtgcaagtgctggacgacattgagaaatgccttgagaagaagcaacagagcgtg

SEQ ID NO: 46 - DNA, 2250 bp, Artificial Sequence
  Codon optimized sequence that encodes an MCM polypeptide with the I671V mutation
atgctacgggctaaaaaccagttgtttctcctatccccccattatcttcgtcaagtcaaagagtccagcgggtccagactgattcagcaaaggctgctgcaccaacagcagcctttgcacccagaatgggctgcacttgctaagaagcagttgaagggcaaaaatcctgaagacctaatttggcataccccagaaggaatcagcatcaagccgctatattccaagcgagataccatggacctcccagaggagctacccggtgttaagccttttacccggggaccttatccgacaatgtacacctttcgaccttggacaatcaggcagtacgccggattttccactgtggaagagagcaataagttctacaaggacaacatcaaagccggccagcaggggctgtccgtggcattcgatttggcaacacaccgcggctacgatagcgataatcctagagtgcgcggcgatgtggggatggcaggcgtcgcgatagataccgttgaggataccaaaatcctgttcgacggcatccctctggagaaaatgtcggtctctatgacaatgaatggagccgtgatccctgtgctcgcgaactttatagtcacgggcgaggaacagggagttccaaaggaaaaactgacagggactatccagaacgatatcttaaaagagttcatggtgcggaacacctatatattcccacctgagccctccatgaagatcattgccgacatctttgagtataccgctaagcacatgccgaagttcaattctatttcaatctccggttaccatatgcaggaggccggagcggatgctatcctagaactggcatacacattggcggacggcctagaatattctagaaccggtctgcaggcagggctcaccatcgatgaattcgccccgcggctgagtttcttctggggcattggaatgaatttctacatggaaattgccaagatgcgtgcaggtcggcgcctgtgggcccatttgatcgaaaaaatgtttcagccaaagaacagcaagtctctgctgctgagagctcactgccaaacttccggatggtccctcaccgagcaggatccctacaacaatatcgtgcggaccgccatcgaggcaatggctgccgtgttcggcggcacccaatctcttcacaccaatagttttgatgaagccttaggactgccaaccgtcaaatccgcacggatcgctcgaaatacacaaatcataattcaggaggagagtgggatccctaaggtcgcagatccctggggcggtagttacatgatggagtgcttgaccaatgacgtctacgacgccgcactcaaactgatcaacgagatcgaggagatgggcgggatggccaaagcagtcgctgaggggatccctaaactccgtattgaagagtgtgcagcccgccggcaagctcggatcgattctggctcagaagtcatcgttggcgttaacaagtaccagctagaaaaagaagatgcagtagaggtgctcgccatagacaatacctccgtgcgcaaccgccaaattgagaaattgaagaagatcaagtcttctcgcgaccaggccttggccgaaaggtgcttagctgcattaactgaatgtgctgcatcaggggatggtaatatactcgctctggcagtcgacgcgtcccgtgccaggtgcacagtgggggaaattactgacgcactgaaaaaagtgtttggtgagcacaaggccaacgataggatggtctctggtgcttatcggcaggagtttggggagtctaaagagataacttctgctattaagcgcgtgcataagttcatggagcgcgaaggacggcgtccccgactgctggtggccaaaatgggacaagacggccatgacaggggggccaaagtgatagcaaccgggttcgcagatctgggcttcgacgtcgatatcggaccacttttccagacacctagggaggtcgctcaacaagcagtcgatgccgacgtccatgcggtgggcgtgtccaccctggctgccggacacaaaaccctggtgccagaattgattaaggagctaaactctctgggccggccagacatcctggtgatgtgtggcggagtgattcctcctcaggattatgagtttctgttcgaggtcggggtatctaatgtgtttgggcccgggactcgcatcccaaaagcggctgtccaggtgttggacgacatagagaagtgccttgagaaaaagcagcagagcgtg

SEQ ID NO: 47 - DNA, 2250 bp, Artificial Sequence
  Codon optimized sequence that encodes an MCM polypeptide with the I671V mutation
atgctgcgggcaaagaaccagctgtttctcctaagccctcattacctccgccaggttaaggagtctagtggctctaggctgattcagcaacgcctactgcaccagcaacaacccctgcaccccgaatgggcggccctggcaaaaaagcagctcaagggcaagaatccagaggatctgatctggcacacacccgaaggcatctccatcaagccgctctatagcaaaagagacactatggaccttccggaagagctacccggagttaaacccttcaccagaggaccttaccccaccatgtacacatttaggccatggaccatccgtcagtacgccggattctctaccgtggaggagtcgaataagttctacaaggataacatcaaggccgggcagcaaggcctctctgtcgcttttgatctggccacacatcgggggtacgacagcgacaacccacgcgtgaggggagatgtaggaatggctggcgtggcgattgacaccgttgaggacactaaaatcctcttcgatggcatacccctggagaaaatgagcgtgtcgatgactatgaatggtgccgtcatcccggtcctggctaatttcatcgtgaccggggaggaacagggcgtgcctaaggaaaaattaaccggcactatccagaatgatattctgaaggagttcatggtcaggaatacctatatttttcccccggaaccatcgatgaagatcattgccgacatcttcgagtacacagcaaagcacatgccaaagttcaacagcataagcatctccggataccatatgcaggaggccggagctgacgctatccttgagctggcatacacgttggcggatggtctggagtattccagaacaggcttgcaggccggcctgacgatcgacgagtttgcacctcggctgtccttcttttggggtattggtatgaacttttacatggagattgcaaagatgcgagcaggtaggcgcctttgggcccaccttatcgaaaaaatgttccagcccaagaacagcaagagcctactgcttagagctcactgtcagacgtccggatggtctttgacggaacaggatccttacaataacattgtccggactgctatagaggcaatggcagccgtgttcggagggacacagagcctccacaccaactcattcgacgaggcacttggcctccccacggtcaaatccgcccgtatagccagaaatacacagattattattcaggaagaatcaggcatccctaaagtggccgacccttgggggggcagttatatgatggagtgcctgacaaacgacgtgtacgacgccgcactcaagctgattaatgagattgaggagatgggcgggatggctaaggctgttgctgaaggcatccctaagctacgcatcgaggaatgtgccgcgagacggcaagctagaattgatagcgggtctgaggttattgtcggcgtgaacaaataccagttggaaaaagaggatgcggtcgaggttctggctatcgacaatacctcagttaggaaccgccaaatcgaaaagcttaagaaaatcaagtccagccgggaccaggcattagcagaaagatgcctagccgctctcactgaatgcgcagcgtctggagacggtaacatcctagccttggcagtcgacgcctcgagagccagatgcactgttggcgaaataactgacgcgctgaaaaaggtctttggcgagcataaggcaaatgatcgaatggtgtcaggagcttacagacaagagttcggtgaaagcaaggagatcacttccgcaatcaagagagtgcacaaatttatggagagagagggccgtcggcctcgcctgctggtggctaaaatgggacaagatggccacgatcgaggggccaaggtaatcgcaaccggctttgccgacctcggcttcgatgtggatataggccctctcttccagacacctagggaagtggcccagcaagccgtggacgccgatgttcacgccgtgggagtttccacccttgcagctggacacaaaactcttgtgcccgagctcattaaggagttgaacagtctcggacgcccagatatcctggtaatgtgtgggggcgtcatcccccctcaggactatgagttcctgtttgaagtcggagtgtcaaacgtctttggccccggaacaaggatcccgaaggctgctgtgcaggtcttagacgacatcgagaagtgcctggaaaaaaaacagcaatccgtg

SEQ ID NO: 48 - DNA, 2250 bp, Artificial Sequence
  Codon optimized sequence that encodes an MCM polypeptide with the I671V mutation
atgctacgcgccaaaaaccagctgttcctgctgtcaccacactacctcaggcaagtgaaagaaagctccggctctcggctcatccaacagcgtctgctacaccagcagcagccactgcacccagaatgggctgccctcgccaagaagcagctgaaggggaagaatccagaggatttgatttggcacacgccggaagggatatccatcaagcccctttacagcaaacgagataccatggacttacctgaagagttgcccggtgtaaagccttttactagaggcccctatcccaccatgtacacgttccggccatggacaataaggcagtacgccggcttttccacagtggaggagtctaataagttctacaaggacaatattaaggccggtcagcaagggctctcagttgcctttgatctggccacccacagagggtacgacagcgataatccacgtgttagaggcgacgtcgggatggccggcgtcgccattgacaccgtcgaggataccaaaatcttattcgacggtattcccctggaaaaaatgagcgtgtcaatgacgatgaatggggccgtcattcctgttttagcaaatttcattgtgactggggaggagcagggggtgcctaaggagaagctcacaggtaccattcagaacgacatactgaaagagtttatggtgaggaacacctacatctttccccccgaaccttccatgaagatcatcgcggacattttcgagtacacagcaaaacacatgccgaagttcaactccatttctatctctggttatcatatgcaggaagccggcgctgacgctatcctggaactggcatatacactcgcagacgggctggagtatagcaggactggcctgcaggccggactgaccatcgacgaattcgcacccagactgagctttttttggggtattggaatgaacttttacatggaaattgcaaaaatgagggcagggcgtcgtctgtgggcccatctcatcgagaagatgtttcagcccaagaatagcaagtctctgttgctacgcgcacactgtcagacatccggttggtcgctgaccgagcaggatccatacaacaatattgtcagaaccgccatcgaagcaatggcagccgtatttggaggaacacagtctctccataccaacagcttcgatgaggcattgggtctgcccacagtgaagtctgccagaattgctcgtaacacacagattattatacaagaggagtccggtattccaaaagtggccgacccatggggggggagctatatgatggagtgcttgaccaatgatgtgtacgacgccgcgctgaaactaatcaacgagattgaagagatgggcggtatggctaaagccgtcgcagaagggatacctaaacttcgaatcgaagaatgtgccgcccgtagacaagctcgcatcgacagtgggagcgaggtgattgtcggcgttaacaagtaccagcttgagaaggaggacgcagttgaggtccttgcaatcgacaacactagcgtaagaaatcgtcagatcgaaaaattaaaaaaaatcaaatcaagccgcgaccaggcactggcggaacgctgcctggccgctctgactgaatgcgcagcatccggcgacggtaatattttagcactcgccgtggacgcgtctcgtgcacgctgcactgtcggagagattacagacgccctgaagaaagtttttggagagcacaaggctaacgaccgaatggtttcaggggcctaccgccaggaatttggggagtcaaaagagataacctctgccataaagagagtccataaattcatggaaagagagggccgtcgacccagacttctcgtcgctaaaatgggtcaggacggacatgacaggggagccaaggtcatcgcaaccggattcgccgatctcggctttgacgtcgacattggcccgctctttcagacaccccgagaggtggcacagcaggcggttgatgcagacgtacacgccgtcggggtctccacactagccgccggacataaaactctggttcctgaacttatcaaggagcttaatagtctcgggaggccggacatcttggttatgtgtgggggcgtgatacccccacaagactatgagttcctctttgaggttggggtatcaaatgtgtttgggccaggcaccagaattccaaaggccgcagttcaggtactcgatgacatcgagaagtgcttggagaaaaagcagcagtccgtc

SEQ ID NO: 49 - DNA, 2250 bp, Artificial Sequence
  Codon optimized sequence that encodes an MCM polypeptide with the I671V mutation
atgctgcgcgccaagaaccagctttttctgctgtcgccccactatcttaggcaagtgaaggaatctagcggcagcaggctcatccaacagcggcttctgcaccaacagcaaccgctgcatcctgaatgggctgccctggctaagaaacaacttaaaggaaagaatcccgaggatttgatttggcatacgcccgagggcatttctatcaagcctctgtattccaaacgagacactatggacctaccagaggagcttcctggcgttaagccctttacccgaggaccctacccgaccatgtatactttcaggccatggaccattcggcagtacgccgggttctccacagttgaggagtctaacaagttctataaagataatattaaagctggccagcaagggctcagcgtcgcttttgatctggctacacacagagggtatgattcagacaatcctcgggttcggggagatgtcgggatggccggggtggctatcgacacagtagaagatacaaaaatcctctttgatggcattcctctcgaaaaaatgtccgtatctatgactatgaacggggccgtgatccccgtgctggcaaatttcatcgttacaggcgaagaacagggcgtgcctaaggagaagttgacaggcacgattcagaatgatatattgaaggaattcatggtgagaaacacatacatcttcccacccgaacccagtatgaagattatcgctgatatttttgaatacaccgctaaacacatgcccaaattcaatagcatttctatatccggctaccatatgcaggaggccggggctgatgccattctagagctggcatacaccctggctgatggactggaatacagccggacaggactccaagcaggtctgacaatagacgagttcgctccccgcttgagtttcttctggggaataggaatgaacttctatatggagatcgctaaaatgcgtgcaggaagaagactttgggcccatctaatcgaaaaaatgtttcagccgaagaatagcaagtccctcctgctgcgcgcacactgccagacttctggttggagcctgacagagcaagatccttacaacaatatcgtgagaaccgctattgaggctatggcagcggttttcggaggcactcaatcactacacacaaactctttcgacgaggccctgggtctcccgaccgtgaagtcagcccgcattgccaggaacacacagatcattattcaggaagagagtggcatcccaaaggtggcggatccttggggtggatcatacatgatggagtgtctaaccaatgatgtgtacgacgctgcgttgaaacttattaatgaaatcgaggagatgggaggcatggctaaggccgtcgccgaggggattcccaagctgcgaatcgaggaatgcgctgctcgacgccaagcccggatcgacagcgggagcgaagtgatcgtgggagtgaacaagtatcaactggagaaggaggatgctgtggaagtcttagcgatcgacaatactagcgtgaggaatcggcaaatcgaaaaactgaaaaagattaagtcttctcgcgaccaggccctcgctgaaaggtgtctggcagctctgactgagtgtgccgctagcggggacggaaatattctcgccctggccgtagatgcctcccgggcgcggtgcacggtcggcgagatcactgacgctctgaaaaaagtgttcggcgagcataaagccaatgaccgaatggttagcggtgcttatcgccaagaattcggggagagtaaggaaataacctccgctattaagcgggtgcacaagttcatggaacgggagggcaggcggcctcggctcttggtggcaaaaatgggacaagatggtcacgacaggggcgccaaagtaatagcaactggatttgctgatctcggctttgatgtcgacatcggtccactgttccagaccccacgggaggtggctcagcaggccgtggacgctgacgttcacgccgtgggagtgtctaccctcgccgcaggacacaagacactggttccggaattaatcaaagagctgaactcgctcggacgccctgacatcctggtcatgtgtggcggcgtgattcccccgcaggattacgaattcttgttcgaagttggagtgtccaatgtcttcggccccggcactcggattccgaaggcggctgtgcaggttctcgacgacatcgaaaaatgtctcgaaaagaaacagcagtcagtc

SEQ ID NO: 50 - DNA, 2250 bp, Artificial Sequence
  Codon optimized sequence that encodes an MCM polypeptide with the I671V mutation
atgttacgggctaaaaaccagttatttttgttatctcctcattacctgaggcaggtgaaagagagcagcggcagcaggctgatacagcagaggttactgcatcagcagcagcccttgcaccctgaatgggcagccttagccaagaaacagctgaagggcaaaaatcccgaagatttgatatggcatactcccgagggaatctccattaagccactgtacagcaagagagatacaatggacctgcccgaggagctcccaggcgtgaagccttttacgagggggccatacccgaccatgtatacgtttcgaccctggactattcggcagtatgcaggattttccaccgttgaggaatccaataaattctacaaagataacatcaaagctggacagcagggcctcagcgtggcttttgatctggcaacccacagaggatacgactcagataatcccagagtgaggggcgacgtgggcatggctggagtcgcaatagacacagtggaagatacaaagatcctgtttgacggtattccactagagaagatgtccgtgtcaatgacaatgaatggtgccgtgatccctgtcctggctaactttatcgtgacgggagaagaacagggggtccccaaagaaaagcttaccgggacaatccagaacgatatcctcaaggaatttatggttcggaacacatacatcttccccccagagccttcaatgaaaattatcgccgatatttttgagtacactgctaagcatatgccaaaattcaattccataagcatttccgggtaccacatgcaggaagccggcgccgacgccatcttggagctggcatatactctggcagatgggctcgaatactccagaaccggactgcaggccggcctcaccatcgacgagttcgcccctaggctctctttcttttggggcatcggaatgaatttctacatggagatcgccaagatgcgggccgggcggcgcctctgggcgcatcttatcgagaagatgtttcagcccaagaattccaagtctctgctccttagagcccattgccaaactagcggctggtccctcacagagcaggacccatataacaatattgtgagaacagcaatcgaagctatggcggctgttttcggcggaacccagagcctgcatacgaattcgttcgacgaagccctaggcctcccaacagtcaagagcgctaggattgccaggaacacccagattataatccaagaggagtccggcattccaaaagtcgctgatccttggggtggatcatatatgatggaatgccttacgaacgacgtgtatgacgccgccctcaagctgatcaacgaaatagaagagatgggcgggatggctaaggccgtggcagaaggcatccccaagttacggatcgaggagtgcgcagcccgtagacaagccagaatcgactctggctccgaagtcattgtcggggtaaacaagtatcagctggaaaaggaagatgcggttgaggtcctggccatagacaacacctccgtgcgaaacagacaaatcgaaaagcttaagaaaatcaagagcagtcgcgatcaggccctggccgaaaggtgcctggcagcccttaccgagtgtgcagcctccggggacggcaatatactggcactggcagtggatgccagtcgcgcacggtgcacagtcggagagatcactgacgcgttgaaaaaagtgttcggggagcataaagctaacgacaggatggtctccggtgcttataggcaggaatttggtgagagtaaagaaataacatccgccattaaaagagttcacaagttcatggaacgggagggaaggcgcccacgactcctagtggccaaaatgggtcaggacgggcatgatcggggcgccaaggtcatcgcaacaggcttcgcagacctgggcttcgatgtggatattggaccgcttttccagacccccagagaggtagcacagcaagcggtggatgccgacgtgcacgctgttggagtatccaccctagccgcgggtcataagaccctggttcctgaactgattaaggagttgaacagcctcgggcgccctgacattctagtgatgtgcggaggcgtgatccctccacaggactatgagttcctgtttgaggtgggggtctccaatgtgttcggtcctggaacccggattcctaaagcagcagtgcaggtgctcgatgatattgaaaagtgtttggagaaaaagcagcagagcgtt

SEQ ID NO: 51 - DNA, 2250 bp, Artificial Sequence
  Codon optimized sequence that encodes an MCM polypeptide with the I671V mutation
atgctgagagcaaagaaccagcttttcttgctctctcctcattacctgcgccaggtgaaggaaagctccggcagcaggctgatccagcagcgtctactgcatcagcagcaacccctgcatcctgaatgggctgctctggcaaaaaagcagctgaagggtaagaatcccgaagaccttatctggcacacccccgaagggatcagcatcaagccgttgtacagcaagcgcgacactatggatctgcccgaggaactgcctggcgtgaagccttttacccggggcccataccctaccatgtacaccttccgcccctggactattagacagtacgcaggtttttccacggtggaggagagtaacaagttctacaaagataacattaaggcagggcagcagggactgagcgtggccttcgatctcgcaacccatcggggatatgactccgataacccaagggttcggggtgatgtgggtatggccggcgtagctatcgatacagtggaagacacaaaaatactgtttgatgggatcccgctggagaagatgtcagtctcaatgacaatgaacggtgccgtgatccctgtgctcgccaacttcatcgtgactggcgaggagcaaggtgtccctaaggaaaagctcaccggcaccatccagaatgacattcttaaagaattcatggtgagaaatacatacatcttcccccctgaaccatccatgaagattatcgctgatatctttgaatacaccgcgaagcacatgcccaagttcaattctattagtatttctggatatcacatgcaggaggctggggctgatgccatattggagctggcatacactctggccgatggcttagaatacagcagaacgggtctccaagccgggctgacgatcgacgaatttgccccaagactcagttttttctgggggatcggcatgaacttttacatggaaatcgccaagatgcgtgcagggaggcgtctatgggcgcatctgatcgaaaaaatgtttcagccgaaaaatagtaaatccctgctgctcagagcccactgccaaacaagcggctggtctcttacagagcaggatccttacaataatattgtgagaacggctattgaggctatggccgctgtgttcgggggtactcaaagccttcacaccaactcctttgatgaggccctgggactgcccaccgtcaagtctgcccggatcgctcggaacacccagatcatcatacaagaggagtctggtattcccaaggtcgctgatccttggggcggcagctatatgatggaatgtctaactaacgatgtgtacgatgcagccctcaagctgatcaatgagatagaagaaatgggagggatggctaaagctgtggcggagggaatacctaaattaagaatcgaagagtgcgcagcccgtagacaggcacgtatcgactccggtagcgaggttatcgtcggtgttaataagtaccagctggaaaaggaggacgcggttgaagtgttggctatagacaatacgtccgtgcgaaaccgccagatagagaaattaaagaagattaagtcatccagagaccaggcccttgccgagcggtgcctagctgctctgactgagtgcgctgccagtggggacggaaatatactggccctcgctgtggatgctagccgcgctcggtgcacagtaggagagatcactgacgcactgaagaaagtctttggcgagcacaaggctaatgaccgtatggtaagtggggcctacaggcaggagttcggcgagagtaaggaaattacatctgcgattaaaagagtgcataaattcatggagagagaagggcggaggcctaggctgctcgtggctaagatgggtcaggatggccatgacaggggtgcaaaagtgattgccacggggtttgcagacctggggtttgacgttgacataggtcctttgttccaaacacctcgcgaagttgcccagcaggctgtggacgccgacgtccatgcagtgggggttagcacccttgccgcagggcacaagacccttgtccctgagttgatcaaagaactgaatagtctgggaaggcctgacatcctggtgatgtgcggaggcgtgatccctccacaggactacgaattcctgttcgaagtgggagtaagtaatgtctttggccccggaactcgaatcccgaaagccgccgtgcaggtgctggatgacattgaaaagtgcctggagaagaagcagcagtctgtc

SEQ ID NO: 52 - DNA, 2250 bp, Artificial Sequence
  Codon optimized sequence that encodes an MCM polypeptide with the I671V mutation
atgctgagagctaaaaaccagctcttcctcctgtcaccccattacttgcgtcaggtgaaagagtccagcgggtcccgactgatccagcagcggttactgcaccagcaacagccactgcacccagagtgggctgcccttgcaaaaaagcagcttaagggcaagaaccccgaagaccttatatggcacacacctgaggggatttctatcaagcctttgtatagcaaaagagatactatggacctgccagaagagcttccaggcgtgaagcccttcacccggggcccctatcccacaatgtacaccttccggccatggacaattcgacagtatgccgggtttagcaccgtcgaggaatccaacaaattctataaagataatatcaaagctggccagcaaggcctgtctgtcgccttcgaccttgccactcacagagggtatgattctgataaccctcgtgtgcgtggggacgtgggcatggccggagtcgcaatcgacactgtagaagataccaagattctcttcgatggtatcccattggagaagatgagcgtctctatgaccatgaatggcgcagtgataccggttttagcaaacttcatcgtgacaggcgaggagcagggcgttcccaaggaaaagctcaccggtactatccagaacgacatccttaaggaatttatggtgcgaaacacctacatctttcctcctgaaccatccatgaaaatcatcgcagatatcttcgaatacactgcaaaacacatgcccaaattcaatagcatctctatatctggctatcacatgcaggaagccggggccgacgccatactggagttggcctataccctggccgacgggctcgaatacagccggacaggattacaggccggcctcaccatcgacgagttcgccccaaggctctcttttttttgggggatcggtatgaacttctacatggagatcgcaaagatgcgcgcagggcgtagactgtgggcacacctcattgaaaagatgtttcagccaaaaaattcaaaaagcctcctactacgggctcactgtcagaccagcgggtggtctctgacggagcaggatccttataacaatatagttagaacggccatcgaagcaatggccgctgtcttcggagggacacaatctttgcatactaatagcttcgacgaggccctcggactgcccacagtgaagtcagccaggatcgcgcgaaacacacagattatcatccaggaagaaagcggaatcccgaaggtggccgatccctgggggggcagctacatgatggaatgcctgacaaatgatgtgtacgacgctgcgttgaagctaatcaatgagatcgaagagatgggcgggatggcaaaggccgtggccgaaggcattccaaagttacggatcgaggaatgtgccgcacgcaggcaagctcgtatagacagcggctctgaggtcattgtgggagtcaacaagtatcaactggagaaggaggatgccgttgaggtcctggcaatcgacaatacaagcgtcagaaacagacaaattgaaaaactgaagaagatcaagagctccagagatcaggcgctggcagagcgatgtcttgcagccttaactgaatgcgctgcctctggcgacggtaatattctcgccctcgcggtcgatgccagcagagctaggtgtaccgtgggagaaattactgacgctctgaagaaggtgtttggagaacataaggctaatgatcggatggtttcaggagcctatcgtcaggaattcggagaaagtaaggagattacgagtgctattaaacgggtacataagtttatggagagagaaggaagacgtccgagattgctggtagccaagatggggcaggatggtcatgatcggggcgctaaagtcattgctactggctttgccgatctggggttcgatgtcgacattggaccactctttcaaactcccagggaggtagcgcagcaggccgttgatgcagatgtgcacgccgtgggcgtgtctactctggccgccgggcataagactctggtaccagaactcatcaaggagcttaacagcctaggacggccagacatcttagtgatgtgtggcggcgttatcccccctcaggactacgaatttctgttcgaagtgggagtgagcaatgtgttcgggcctggcactcgaatcccaaaggctgcggtccaggtcttggacgacatcgaaaagtgcctggagaaaaagcaacagtccgta

SEQ ID NO: 53 - DNA, 2250 bp, Artificial Sequence
  Codon optimized sequence that encodes an MCM polypeptide with the I671V mutation
atgttgagggcaaagaaccaactgttcctgctgtcgccccactacctcagacaggtcaaggagtcatctgggtccaggctgatacagcagaggctgctccaccagcagcagcctttacaccctgagtgggctgcacttgctaaaaagcaactgaagggtaagaatccggaagatctgatttggcacactccagagggcatatctatcaaaccactctattccaaacgggacacgatggacctgccggaagagctgcccggcgtcaaacccttcacccgaggaccatacccgacaatgtacacatttaggccctggacaatccgccaatacgctggatttagcactgtggaggagagcaacaaattttacaaagacaacattaaagcgggccaacaaggtctttctgtggcatttgatctcgctactcataggggctatgactcagataacccacgagtaaggggggacgttggaatggccggcgtggcaatcgataccgttgaagatactaaaatactgtttgatggtattccactggagaaaatgagcgtgtccatgacgatgaacggtgccgtgatccccgtgctagccaactttatcgttacgggcgaagaacagggagttcccaaggagaaattaactggtactatccaaaacgacattctgaaggagtttatggtccgcaatacttacatctttcctcctgagccaagcatgaagataatagccgacatcttcgagtatactgcaaagcatatgccaaagttcaattccattagtatctcaggctaccacatgcaagaggcaggtgcagatgctattttggaactggcttatacgctggcagatgggctggaatacagcagaacgggcttgcaggccggcctgaccatcgacgaatttgcgccccgcttgagctttttctgggggattggaatgaacttctacatggaaatcgctaagatgcgagcgggccggcgactctgggctcatctgatcgagaagatgttccagccaaaaaattcgaaatctcttctcttgagagcgcattgtcaaacttccggttggtccctgaccgagcaggacccctataacaacatcgtccgcactgctattgaagccatggccgccgtttttggtggtacacagagccttcacacaaactcttttgacgaagccctgggattgcccactgttaagtcagcgagaatcgctcgaaatacccagattattatccaggaggaatcaggcattccgaaggtggccgatccatggggggggtcctacatgatggagtgtttgacaaacgacgtatatgacgcagccctgaagttgatcaatgaaatcgaggagatgggcgggatggccaaggccgtagctgaaggtattcccaaactgcgaatcgaggaatgcgcagccagacgccaggcacgaattgactcgggtagtgaggtgatcgtcggcgtgaacaagtaccagctcgagaaggaggacgctgtcgaggtcttggcgattgataacactagcgttcgaaatcgacagattgaaaagttaaagaaaatcaagagctcaagagatcaggccctggctgaaagatgtctcgccgcactgactgagtgtgcagcttccggagacggaaatatcctggccttggcagttgatgcaagtcgtgccagatgcactgtgggtgaaatcacagacgccttaaaaaaagtcttcggagagcataaggcgaatgaccgtatggttagcggcgcttacagacaagagttcggcgagagcaaggaaatcaccagcgcaataaaacgtgtgcataaattcatggaacgggaaggccggcgtcctcggctgctcgtggccaagatgggccaggacggccacgataggggcgccaaggtcattgctaccgggtttgctgacctcggatttgatgtcgacattggcccactttttcagacgcctcgggaagtcgcacaacaagctgttgatgctgacgtccatgcagtgggtgtgagtacgcttgctgccggtcacaagacactggtccctgagctgataaaggagttgaactcccttggacggcctgatatcctggtgatgtgcggaggcgtcatccccccacaggactatgaattcttgtttgaagtaggcgtgagtaacgtgttcggtcctggaacaagaattccaaaggcagctgtgcaagtcctagacgatattgaaaaatgccttgagaaaaagcaacaatcggtg

SEQ ID NO: 54 - DNA, 2250 bp, Artificial Sequence
  Codon optimized sequence that encodes an MCM polypeptide with the I671V mutation
atgctccgagccaagaatcaactcttcctcctctctccgcactatttgagacaagttaaggagagctcaggctcccggctaattcagcagcgactcctgcatcagcagcagccactgcatccagagtgggctgctctggctaagaagcagctgaagggaaagaaccccgaagacctgatttggcacacccctgaggggattagtatcaagcctctctactcgaagagagatactatggaccttcctgaggagctgcccggggtcaaaccattcaccaggggaccatatcctaccatgtacaccttccggccttggacaattaggcagtatgctggattttctaccgtggaggagagtaataagttttataaggacaatattaaagctggtcaacaaggattgtccgttgccttcgacttggccacccatagggggtatgacagcgacaatcccagggttcgcggagatgtcgggatggcaggcgtggccattgatactgtcgaggataccaagattttgtttgacggaatcccacttgagaagatgtccgtatctatgacaatgaatggcgctgttatccccgttcttgccaatttcatcgtcaccggcgaggaacagggagtgcctaaggagaaacttacggggactatccagaacgatatcctgaaggagttcatggttagaaacacttatatattccctccagaaccgtcgatgaagatcattgccgatatttttgaatacactgccaagcatatgccgaaattcaactcaatcagcatctcagggtatcacatgcaggaagcaggcgcagatgcgattctggaattagcatatactctggccgacgggctggaatactcacggacaggtctgcaggcaggcttgaccatagacgaatttgcccccagactttcctttttttggggaattggtatgaatttttatatggagattgctaagatgagagccgggcgcagactgtgggcccatctaatagaaaaaatgtttcagcccaaaaacagcaaatccctgcttctgagggcccactgccagacaagcggatggagtctgaccgaacaggatccatataacaacatagtgcgaacagcgatcgaagctatggccgccgtatttggggggacccagagtctgcacaccaattcctttgacgaagcacttggcctccctactgtcaaatctgcacgcattgcccggaacacacagatcatcattcaggaggagtctggcatccccaaagtagccgacccatggggggggtcgtacatgatggagtgtttaacaaacgatgtatatgacgccgccctgaaattaatcaacgaaatcgaggagatgggaggcatggctaaggcagtggctgaaggaatacccaagctccgaatcgaggagtgcgccgcgcggcgacaggcgcgcattgactctgggagcgaagtcatagtcggtgtgaataagtaccagctagagaaggaggacgcagtcgaggttttggccatcgataacacatccgtgcgcaacagacagatagagaaattgaagaagatcaagtcctcaagggatcaggctcttgcggagcggtgcctcgccgccctgactgagtgcgcagcatctggcgacggcaacatcctcgccttggcagtggatgcaagccgggctcgatgtaccgtgggcgagattacagacgcacttaagaaagtgtttggagagcataaagcaaacgatcgcatggtgagtggcgcttacagacaggagttcggcgagtccaaagaaatcactagcgccatcaaacgggtccacaagttcatggaaagggaaggcagaaggcctcgtctcctcgtcgccaagatgggccaggatgggcacgaccgcggagccaaggtgattgctactggctttgcggatcttgggtttgacgttgatattgggccgctttttcagactccaagagaggttgcccagcaggctgtcgatgctgatgtccacgccgtgggcgttagcaccctggctgccggtcataagaccctggtaccagaattaataaaggaacttaacagccttgggcgcccggatattctagttatgtgcggtggtgttatccctccccaagactatgaattcctgtttgaagttggagttagcaacgtgtttggtcctgggacaagaattcctaaggccgcggtacaggtcctcgacgatatcgaaaagtgtctcgaaaagaagcaacagagcgta

SEQ ID NO: 55 - DNA, 2250 bp, Artificial Sequence
  Codon optimized sequence that encodes an MCM polypeptide with the I671V mutation
atgttgcgggccaagaatcaactgttccttctttctcctcactacttacggcaagtgaaggagtcttccggatccaggctaattcaacaacggctcctgcatcagcagcagcctctgcacccggagtgggccgcccttgccaaaaaacagctcaaaggtaagaacccagaggatctgatctggcacacccccgaaggcatcagtatcaagcccctgtatagtaaacgggacacaatggacctgccggaggagctgccgggagtcaagccctttactcggggtccataccccacaatgtacacttttcggccttggactatccgccagtatgccgggttcagcaccgtagaagaaagtaacaaattttacaaggacaatattaaagcagggcaacagggtctgtcagtggcatttgacctggccactcacagagggtatgactctgataacccccgcgtgagaggcgatgtaggcatggcaggtgttgccattgacacggtcgaagatacgaaaatcttgttcgatggaatccccctcgaaaaaatgtcagtgagcatgactatgaacggagccgtaatccccgtgctggctaatttcatcgtaaccggcgaggagcagggcgtccccaaggagaaactgaccggcacgatacagaatgacatcctgaaggagtttatggtccgtaacacctacatattcccacccgaaccgtcgatgaaaattatcgctgatatatttgaatacacggccaagcacatgcctaagttcaactccattagcatctctggctaccacatgcaagaagcaggggctgacgccatcctggaactcgcctacacactggctgatggacttgaatactctagaaccggtctgcaagctgggttgacgatagatgagtttgctcccaggctctcattcttctggggcataggtatgaatttctatatggagatagctaaaatgagggccggtaggaggctgtgggcccaccttatcgaaaaaatgttccaaccgaagaatagcaagtctcttttgctgcgcgcccactgccagaccagtggctggtcacttacagaacaggatccatacaacaacattgtcaggactgccatcgaagccatggccgcggtttttggaggaacgcaatccttacacacgaacagctttgacgaggctttaggcttacccacggtgaagagcgctcggatagcaagaaacacccagataattattcaagaggaatcagggattccgaaggtagcagacccttggggcggttcctacatgatggagtgcctcactaacgacgtctacgatgccgctcttaaactcattaatgagatcgaggagatgggcggaatggcaaaagcagtcgccgaagggatcccaaagctcagaattgaggagtgtgccgctcgtcggcaagcaaggattgactcaggcagcgaggtcatcgtcggggttaataagtaccagctcgagaaagaagacgctgtggaggtgctcgctattgacaataccagcgtgcggaaccgtcagatagagaaattgaagaaaataaagtccagccgagaccaggcgctggcagaaaggtgtctggctgccctaacagagtgtgccgcgtctggcgacggcaacatcctggctctggcagtggatgcaagtagggcgaggtgcacggtgggggagatcactgatgccctcaagaaggttttcggggagcacaaggccaacgaccggatggtgagcggagcgtaccgacaagaattcggtgagtctaaggagattacctcagccatcaagagagttcacaaatttatggagagagaggggagacggcctcgcctcctggtggctaaaatgggacaagacggtcacgaccgaggagctaaggtgattgcaaccggctttgcagacctggggttcgacgtggatatcggccctctgtttcaaacgcctagggaagtcgcccagcaagccgtggacgctgatgtgcatgcagtgggagtgtcaactttggccgccggacacaagaccttggtccccgaactgatcaaagagctgaattccttgggaaggcccgatatacttgttatgtgcggcggggtgattcctccgcaggactatgagttcctgtttgaggtgggggtgagcaacgtcttcggacccggtaccagaatcccaaaggcagctgtgcaggttttggatgatattgagaagtgtctcgagaagaaacagcagtcggtg

SEQ ID NO: 56 - DNA, 2250 bp, Artificial Sequence
  Codon optimized sequence that encodes an MCM polypeptide with the I671V mutation
atgctccgcgccaaaaatcagctcttcctcctcagcccccattatctccgccaagtgaaggaatctagtggaagcaggctgatccagcagcggctgctccatcaacagcagccccttcaccctgagtgggcagccctggccaagaaacagctgaaaggaaaaaaccccgaagatctgatctggcatacaccagaggggatatcaatcaagccattgtatagcaaaagagatacgatggatcttccagaagagctgcccggtgtcaagccctttaccagaggcccctaccctaccatgtatacttttcgtccttggactatccggcagtatgctggctttagcactgtggaggagtcaaacaagttctacaaagacaatataaaagcaggacagcaaggcctttctgtcgcctttgacctcgccactcacaggggctatgatagcgacaacccaagagtaagaggtgatgtaggcatggccggagtggctattgacactgtggaggatacaaaaatcctctttgatggcatccctctggagaaaatgtctgtgtccatgaccatgaacggagccgtgatccccgtcctggcaaacttcatcgtcacgggggaagaacaaggcgtgccaaaagagaagctgaccgggaccattcagaacgacattctgaaagagtttatggttcggaatacctacattttccccccagaaccatccatgaagatcattgccgatatcttcgagtatactgcaaaacacatgccaaaatttaactccattagcatctccgggtaccatatgcaggaagctggagcggacgctattctcgagcttgcatacacccttgcggatggactcgagtactctcgcacaggcctccaggctggcctgacaatcgatgagttcgctccacggctgagcttcttctgggggatcggaatgaatttttatatggagatagctaaaatgcgggcggggcggcgtttatgggcacacctgatcgaaaagatgttccaacctaagaactccaagtccttgctgcttcgagcccactgtcagacctcaggatggtctttgaccgagcaagacccttacaataatattgtccgtaccgctatcgaggccatggccgccgttttcggaggcacgcagtcactccatactaatagctttgatgaggctctgggactgccaacggtgaaatccgcccggatagcccgtaatactcaaatcataatacaggaggagtcaggaattcccaaagtggccgacccttggggaggaagctacatgatggaatgccttaccaatgacgtgtacgacgctgccctgaaactgattaatgagattgaagagatgggggggatggcaaaagctgttgccgagggtatcccgaaactgaggattgaggagtgcgctgcaaggcgtcaggccagaattgattccgggagtgaagttatcgtgggggtgaataagtaccaactagagaaagaagatgcggtcgaggtcctggcgatcgacaatacaagcgttcgcaatcggcagatcgaaaaattgaagaagataaagtcttcaagggatcaggctctggcagagcggtgtctggccgccctcactgagtgtgccgcatcaggcgatgggaacatactggctctagcagtggacgccagccgtgctcggtgcactgtgggggaaattactgatgctctcaagaaggtgttcggagagcacaaggcaaacgatcgcatggtgtctggtgcatacagacaggagtttggcgagtctaaggagatcacgtctgctattaagagggtgcataaatttatggagagggaggggcgccgccctcggctgctcgtcgccaaaatgggccaggatggacatgataggggagccaaagtgatcgctactggatttgccgatttagggtttgacgttgatatagggccactcttccagacccctagggaagtcgctcagcaggccgtagatgccgacgttcacgctgtgggcgtgtctaccctggctgccggacacaaaaccttggttcctgagctaattaaagagcttaattccttaggtcgaccagacattctggtgatgtgtggtggagtgataccccctcaggactacgagtttttgtttgaggttggcgtttcgaatgtgttcgggcccggtacacgcattcccaaagcagctgttcaggtgctggacgacattgagaaatgtcttgagaagaagcaacaatccgtg

SEQ ID NO: 57 - DNA, 2250 bp, Artificial Sequence
  Codon optimized sequence that encodes an MCM polypeptide with the I671V mutation
atgctcagggccaaaaaccagctttttctcctctccccacattaccttagacaagtgaaggaatcctccggatccaggcttatccagcaaaggctcttgcaccagcagcagccgctgcatcccgaatgggcggccctcgcaaagaagcagttaaagggcaaaaaccccgaagatctcatatggcacaccccggagggtatctccataaagcccttgtattcaaagcgcgatacgatggacctgccagaggaactgccgggggtgaagccatttactagagggccatatcccaccatgtataccttcaggccctggaccatccgacagtacgctggcttctccaccgtggaggagagcaataaattttataaagacaacataaaagccggccagcaaggactctcagttgcgtttgaccttgccactcaccgtgggtacgattccgataatcctagagtaaggggggacgtgggcatggcgggggtggcaattgataccgttgaagacactaagattttgtttgatggcatccctctggagaagatgtccgtttccatgactatgaacggtgctgtcatcccagtgctggccaatttcattgtgactggcgaagagcaaggggtacccaaggaaaagctgacgggaaccatccagaacgacatcctcaaggagttcatggtgcgcaacacctacatctttccaccggagccctcgatgaaaataatcgccgacattttcgagtatactgccaagcatatgcctaaatttaattccattagcatcagcggctaccacatgcaggaagccggtgcagacgccattctggagctcgcctacactctcgctgacggactggagtatagcaggaccggcctccaggcgggcctgacgatagacgagttcgcacccaggctatcattcttctggggtatcggcatgaatttctacatggaaattgccaagatgagggcaggcaggcgcctgtgggcccacttaattgagaagatgttccagccaaagaattcaaagagtctgctattgcgggcccattgtcagacctctggctggtcgctgacagaacaggatccatataacaacattgtgcgcaccgccatcgaagctatggcagccgtttttggaggaacccagtccctgcacacaaattcttttgatgaggctctgggcctgccgactgtcaaaagtgcgaggatcgccaggaacactcagattattattcaggaggaatcgggtatcccgaaagtcgccgatccctggggaggatcttatatgatggaatgcctgaccaacgacgtgtatgacgcagcccttaaattgataaacgagatcgaggaaatgggaggtatggcaaaggcggtggccgaagggattcccaaactcaggattgaggagtgcgccgcccggagacaggcacgcatcgattccgggtccgaagtgatagtaggagtgaacaaataccaattggaaaaggaggacgccgtggaggtcctcgccattgacaatacgagcgtgcgcaacaggcagatagagaagttgaagaagattaaatctagccgtgaccaggcactcgccgagcgatgcctagcagctcttacggagtgtgccgccagcggagatggcaacatccttgctctcgccgtcgatgcaagtagagcaagatgtaccgtcggcgagataactgatgccttaaagaaggtttttggcgagcacaaggcaaatgacagaatggtctcaggcgcatatcggcaagagttcggagagtccaaagagatcacgtctgccatcaagagggtacacaaattcatggagagggaaggaagaagaccacgactgctggtcgctaagatgggccaggatggtcacgaccgcggcgcaaaagtgatcgcaacagggtttgctgacttgggctttgacgtggacataggacctttattccagacgccgcgggaagtggcacagcaggctgtggatgcagacgtgcatgcagtgggagtgtcaaccctggccgccgggcacaagaccctcgtgccggagctgattaaggaactgaactccctaggccggcccgatattctcgtgatgtgcggcggcgtcatacctcctcaagactacgaattcctgttcgaagtaggagtcagcaacgtttttgggccagggacaaggatcccaaaggcggctgttcaagttttagatgacatcgagaaatgcctcgagaaaaaacaacagtcagtt

SEQ ID NO: 58 - DNA, 2250 bp, Artificial Sequence
  Codon optimized sequence that encodes an MCM polypeptide with the I671V mutation
atgctgagggcaaaaaatcaactctttcttctgtccccacactacctgcgtcaggtaaaggagagttccggtagcagattgatccagcagagactgctccatcagcagcagcctctgcatcccgagtgggccgctctggctaaaaaacagctgaaggggaagaatcccgaggacttgatctggcatacccctgagggaatctccatcaagcctctatacagcaagcgggacacgatggatcttccagaagagctgcctggagtgaagcctttcaccagagggccgtaccctacaatgtacacatttcgcccctggactattcgtcaatacgctggctttagtacagtggaggaaagcaacaagttttacaaagataatatcaaggctggccagcaaggcctgtcagtcgcttttgaccttgctacccatcgggggtatgacagcgataacccccgcgtgagaggagatgttggaatggccggtgtggccatagatacagtggaagatacgaagattctcttcgatggtatcccactggaaaaaatgtctgtgagcatgaccatgaatggagctgttattccggtgcttgctaattttattgtgactggagaggagcagggagtgccaaaagaaaagctcacgggcacaattcagaacgacattttaaaggagttcatggtcagaaacacctatatcttcccccccgagccctcaatgaaaattattgctgacattttcgagtatacggcaaagcatatgccaaagttcaactctatttccatctctgggtatcatatgcaggaggctggcgccgacgccatcctcgagttggcatacacactcgcggacggccttgagtactcacgaactggcctccaggcagggttgactatcgacgagtttgccccaaggttgtcattcttttggggaattggaatgaacttttatatggaaatcgcaaaaatgagggccggaagaaggttgtgggcccatctcatcgaaaagatgtttcaaccaaagaacagtaagtcactgctgctccgggcccattgtcagaccagcggatggtcactaactgagcaagacccttacaacaatattgtgcgaactgccatcgaggccatggctgccgtgttcggcggaactcagagtctgcacactaacagcttcgatgaggcactcggcttgccaaccgtgaagtctgccaggatcgctaggaatactcaaatcatcattcaagaagagtcagggataccgaaagtagcggacccatggggtggctcttacatgatggaatgcctgaccaatgacgtgtacgacgccgctctcaagctcattaatgagatcgaagagatgggagggatggccaaagcggtcgcagaaggaatccccaagctacgcatagaagagtgtgctgcacgccgtcaggcgagaatcgatagtgggtctgaagtcatcgtgggcgttaataagtaccagttagagaaagaggatgcagtcgaagttctggccatagacaatacttctgtacgcaatagacagatcgagaaattgaagaaaatcaaatcttcaagagatcaggcgctggcagaaaggtgtctggccgctctgacggagtgtgccgcttccggcgatggcaatatacttgcactcgccgttgacgcgagtcgggcacgctgcaccgttggcgagattactgatgccctcaagaaggtctttggggagcacaaggcaaacgaccgcatggtaagcggagcctacagacaagaatttggggagagtaaggagattacatccgctattaagagagtacacaagttcatggaaagggaaggacggcgtcctcgcctgttggtggcaaaaatggggcaggatggtcacgacagaggggctaaagtaattgccacaggctttgctgatcttggatttgacgttgatatcggcccactgtttcagaccccccgcgaagttgcccagcaggcagtggatgctgacgtgcacgcagtcggcgtgagcaccctggcagccgggcacaaaactctggtcccagagctcattaaggagctcaattcactcggccgccccgacattctcgtaatgtgcggaggagtgatacctccccaggattacgaattcctgttcgaagttggggtctccaacgtctttggcccaggcacaagaatcccaaaggccgctgtgcaggtactagatgatatcgagaagtgccttgaaaagaagcaacagtctgtt

SEQ ID NO: 59 - DNA, 2250 bp, Artificial Sequence
  Codon optimized sequence that encodes an MCM polypeptide with the I671V mutation
atgctcagagccaaaaatcagctcttcctgctgagcccacactacttacgtcaagtgaaagagagctctggcagcagactgattcaacagcggcttctccatcagcaacagccactccaccccgaatgggcagccctggccaagaaacagcttaaggggaaaaatccagaggatcttatttggcacactccagagggcattagtatcaagcccttatattcaaagagagataccatggatctccccgaagagcttccgggtgttaagcctttcacgaggggcccataccctacaatgtacacgttccgaccatggaccatccgacagtacgctggtttctctaccgttgaagagtccaacaagttttataaagacaatattaaagccggccagcagggcctcagcgtggcatttgacctcgctacccatcggggctatgattcagacaacccaagggtgcggggcgacgtcggaatggccggggtggcaattgatacggtagaggatactaaaatcctcttcgacgggatcccccttgagaaaatgagcgtaagtatgaccatgaacggcgccgtgattccggttctcgctaacttcattgtgacaggtgaggagcaaggtgtccctaaagaaaagctcaccggaacaattcagaacgacattctcaaggagttcatggtgaggaatacatacatctttcctcccgagccaagcatgaaaattattgctgatatcttcgaatacaccgccaaacatatgcctaaattcaattcgatttctatctccggttaccacatgcaagaagccggggccgatgccattctggagctggcttacacgctagcggacggtttagaatattcccgtacaggcttgcaggctgggctgaccatcgacgaatttgcccccaggctctctttcttctgggggatcggcatgaacttttatatggaaatcgctaagatgcgtgccggaagaagactctgggcccacttaatcgagaaaatgttccagcctaaaaattctaaaagccttctgctgagggcgcattgtcagacaagtgggtggtctttgacagagcaggatccctacaataatatcgtgagaacagccatcgaagctatggccgcggtcttcggcggcacacagagcctgcataccaatagctttgatgaagccctaggtttacctacagtaaagtccgcgagaatcgctcgaaacacccagatcatcattcaggaagagagtggtataccaaaggtggccgatccttggggcggctcgtacatgatggaatgcttaaccaatgacgtgtacgatgccgctcttaaactcattaacgagatagaggagatgggaggcatggctaaagctgtcgccgaaggtatccctaaactccggattgaagaatgcgctgcccgcagacaggctcgtatagattcaggctccgaggtgattgtcggcgtgaacaaataccagctggagaaggaggacgccgtcgaagtgctggcaattgacaatactagcgtccgcaataggcaaatcgaaaagttgaaaaagatcaaatcctcacgggatcaggcgctggcagagagatgtctggctgccttgaccgagtgcgctgccagtggtgacggtaacattctggcattggccgtggatgcatcacgtgcccggtgcactgtgggagagatcaccgacgccctgaagaaggtattcggcgagcataaggcaaacgatcgaatggtttcaggtgcttacaggcaggaattcggagagtcaaaagaaattacgagtgcaatcaagagggtccataaatttatggaaagggagggcagaaggcctcgcttactggttgctaaaatggggcaggacgggcacgatcgcggagctaaggtgattgccacaggatttgcagacttaggttttgacgtggacattgggcccttattccagaccccccgcgaagtggctcagcaagctgtggatgcagatgtccacgccgtaggggtgagcactcttgccgccgggcacaaaacactggtgccagagctgatcaaggagctgaactccctgggccgacctgacatattagtcatgtgcggaggagtcattcctccgcaagattatgaatttctgttcgaggttggggtgtccaacgtctttggaccagggactagaatcccaaaagccgctgttcaggtgctggacgatattgaaaaatgtttagaaaaaaaacaacagtctgta

SEQ ID NO: 60 - DNA, 2250 bp, Artificial Sequence
  Codon optimized sequence that encodes an MCM polypeptide with the I671V mutation
atgctaagggccaaaaatcaacttttcctgctgagcccgcactatttaaggcaggttaaggaatcctcaggttccaggctgatacagcagcggttgctccatcagcagcaacctttgcatcccgagtgggctgctctggcgaaaaagcagttaaaaggcaaaaatccagaggacctcatctggcatactcctgagggcatctctattaagcccctgtattccaaacgcgatacaatggatcttcccgaagaattgccaggtgttaagccattcactagggggccttaccctaccatgtacacgtttcggccttggacgatccgccagtatgcaggatttagcaccgtggaggagtctaataaattctacaaagataacattaaagcgggccagcaaggtctgtccgtagccttcgatttggccacccatcgagggtacgattccgacaatcctcgggtgcgaggtgacgtagggatggccggggttgccattgatactgttgaggatactaaaatactcttcgatgggatcccccttgaaaaaatgagcgtgtcgatgacaatgaatggggctgtgatccctgtcctggctaactttatagtgacaggagaagagcaaggagtcccaaaggaaaaactcactgggacaattcagaatgacatactcaaggagtttatggtgcgaaatacatacatcttccccccagagccctccatgaagatcattgctgacatcttcgagtataccgctaaacatatgcctaaattcaacagcatatcaatctccgggtatcacatgcaagaggccggggcagatgcaatacttgagctcgcgtatacactggccgatggccttgagtatagcagaaccgggctccaggccggcctgactattgatgaatttgcgccacgtctctcctttttctggggaatcgggatgaatttctacatggagatcgccaaaatgcgcgccggtaggcggctgtgggctcacctgattgagaagatgttccagcccaagaatagcaagagccttctgctcagagctcattgccagacctcaggatggagcttaacggaacaggatccgtacaacaatatcgtgcggacagcaatcgaggcaatggccgccgttttcggtggcacccaatcactgcatactaactcgttcgatgaggcgctaggcctccctacagtgaaaagcgcaaggatcgccaggaacactcagataataatccaggaagaatctggcatccctaaggtggctgacccctggggaggttcttacatgatggagtgcctgactaatgacgtttatgatgccgcgctgaaacttatcaacgagattgaagaaatgggaggaatggccaaggctgtcgctgaaggcatccccaagctgaggatcgaagagtgtgcagcacggaggcaagccaggatagatagtggcagcgaagtcatcgttggcgtgaataagtaccagcttgagaaggaagatgcagttgaagtcctcgccattgacaacacctctgtgcggaaccgtcagatcgaaaaactgaagaagatcaaaagctccagagaccaggccttggcggaaagatgtctcgcggcattgacagagtgcgcggcttctggggatggtaacatcctggcccttgccgttgacgcatctcgggccagatgtactgtcggagaaattaccgacgccttgaagaaggtgttcggagagcacaaagcaaatgaccggatggtcagcggtgcctacaggcaggagtttggcgaaagcaaagaaataaccagcgccataaaacgtgtccataaattcatggaacgggagggccgacggcctcgcctcctggtggccaagatgggccaggatggccacgataggggggctaaggttatcgctaccggttttgctgatcttggattcgatgttgacatcggcccactgttccaaacccctcgagaggtggctcaacaggccgtggatgccgatgttcacgcagttggcgtaagcaccttggccgcaggccacaaaacgctggtgccagaactcatcaaagagttgaacagtctgggacggcccgacatactggtaatgtgcggcggagtgatcccacctcaagattacgagttcttatttgaggtgggtgtgagcaatgtgttcggacccggcacccggatcccaaaagccgccgtccaggttctcgatgatattgaaaagtgcctcgaaaaaaagcaacaatcggtt

SEQ ID NO: 61 - DNA, 2250 bp, Artificial Sequence
  Codon optimized sequence that encodes an MCM polypeptide with the I671V mutation
atgcttcgtgctaaaaatcagttatttttgctctcaccacactacctgcggcaggtgaaagaatctagcgggtcccgcctgatccagcaacgactgttgcatcaacaacagcccctccatcctgaatgggctgctcttgcaaagaaacagcttaagggtaaaaatccggaagatttgatctggcacacaccagagggcatttctattaagcctttgtattcaaaaagggatactatggacttacccgaggagctgcccggagtcaaacccttcacccgtggcccgtatcccaccatgtatactttccggccgtggaccattaggcagtacgcagggttctccaccgtcgaagaatcaaataagttctacaaggataatatcaaagctggtcaacagggcttatctgtggctttcgatctcgccacccacagagggtatgacagtgacaatcctcgcgtgcgaggagatgtcgggatggctggcgtcgctatcgacactgtggaggatacaaagatactgtttgatggcattccactcgagaaaatgagcgtgtccatgactatgaatggtgccgtgattcctgttctggctaattttatcgtgacaggagaggagcaaggtgtgcccaaggagaagctcaccggtaccatccagaacgacatcctcaaggaattcatggtccggaatacttacattttccccccagagccatccatgaagatcatcgccgacatcttcgaatacaccgcaaagcacatgccgaagttcaactctataagtatctccggctaccacatgcaagaagccggagccgatgccatcttggagcttgcatatactttagctgatggactggaatattctcgtacggggctgcaggctggcctgaccatagacgagttcgcgccacgactgtcatttttctggggcattggaatgaatttttatatggagatcgccaagatgcgggccggtagacggctgtgggctcacctgattgaaaaaatgttccaaccaaaaaactctaagagcttgttgctgagggcgcactgtcagacttcaggctggagtcttacagagcaagacccttacaacaacatcgttagaacagctattgaagccatggctgctgtatttggaggcacccaatccctccacaccaactcattcgatgaggccctgggcctcccgacagtcaaatccgccagaatcgctaggaacacacaaataattattcaggaagagagcggaatcccaaaggtggcagacccttgggggggcagctatatgatggagtgcctgactaacgacgtctacgatgccgcccttaaactgattaatgaaatcgaagagatgggtggcatggctaaggcggtggccgaaggcatcccaaaactgcgcatagaggaatgtgccgcccgccggcaggcgaggatcgactcgggaagcgaggtgattgttggggtgaataaataccaactggaaaaagaggacgccgttgaggtcctggcaatagataacactagtgtgcgtaaccggcagattgagaagcttaaaaagatcaagtcctctagagaccaagccctggcggaacgttgtctggccgccctgacagaatgtgcggcaagcggggatggaaatattctggcactggcagtggatgcttcccgagctcgttgtaccgtcggggagatcacggacgccctgaaaaaagtgttcggcgagcacaaggctaatgacagaatggtttcaggcgcttataggcaggaatttggtgagagtaaggagattactagcgctattaaacgggttcataagttcatggaacgagaaggtcgacggcctagactactggtagctaaaatgggccaagacggccacgacagaggggccaaggtcattgcgactggctttgccgatttgggcttcgacgtcgatatcggaccacttttccagacgcctcgagaggtagcacagcaagcagtcgatgccgatgttcatgccgtgggagtgagcacactggcagcgggccacaaaacactagtgcccgaactgatcaaggagctgaattccctcggcagaccagatatcctagtaatgtgtggcggcgttattcctccacaggactacgaattcctatttgaggtcggcgtcagtaacgtgtttgggcctggcactcgtattcccaaagcagcggtgcaggttctagacgatattgagaagtgcctggaaaaaaagcaacaaagcgtg

SEQ ID NO: 62 - DNA, 2250 bp, Artificial Sequence
  Codon optimized sequence that encodes an MCM polypeptide with the I671V mutation
atgctccgtgctaaaaatcagctttttctgctatccccccactatctgagacaggttaaagaatcgtctggctccagactgattcagcagcgccttcttcaccagcagcagccattgcaccccgagtgggctgcgctcgccaaaaaacagctgaaggggaaaaaccctgaggacttaatctggcataccccagaaggtatcagcataaagcccctgtatagcaaacgggatacgatggacctgcctgaagaactgccaggcgtgaagccgtttaccaggggtccataccccaccatgtatacctttcgcccttggactatccggcagtacgcgggattctctacagtggaggagagtaataaattttacaaggataatataaaggcaggccaacaggggctgtctgtcgcctttgacttggccacgcacagagggtatgattccgataacccgcgcgtgcggggcgatgtgggcatggctggcgtcgctattgacacagtggaggacacaaaaatactctttgatggtatccccttggagaaaatgagcgttagtatgactatgaacggggcagtgatccctgtgctcgccaatttcatcgtgacaggcgaagagcagggcgtgcctaaagaaaaactgaccggaaccatccaaaatgatatcctgaaggagtttatggtgcgaaacacctatatctttcctcctgagcccagtatgaaaattattgctgacatattcgaatacacagctaaacacatgcccaaatttaactcgatttctatatcaggttaccacatgcaagaggctggtgctgatgctatcctcgagctcgcgtatactctcgcagatggccttgagtactcacgcaccggactccaggccggtctcactatcgacgagttcgccccacgcctgagctttttttggggcatcgggatgaatttttacatggaaattgccaagatgcgagccggaagacggttatgggcgcacctgattgaaaaaatgttccagcctaagaatagtaaaagtttgctactgcgcgctcactgccagacaagcggatggtctcttactgagcaggatccatacaacaacatcgtgcgcactgctatcgaagctatggctgcagtgtttggcggaactcaatccctccacacaaactccttcgacgaagccctgggcctgccaacagtgaagtccgctaggatcgctcggaatacccaaatcatcattcaggaggaatctggtattcccaaagttgctgatccttggggtggctcctacatgatggaatgtttgacaaacgacgtgtacgatgctgcgcttaaactgattaacgaaatcgaagagatggggggcatggctaaagcagtggctgagggcattccaaaactccgcattgaggagtgtgcagctcgacggcaagcccgaattgactcgggtagcgaagttattgtgggcgtaaacaagtaccaactggagaaggaggacgctgttgaagtcctagcgattgataacacctccgtccgtaacagacaaattgagaagttgaaaaagatcaagagttcgcgggaccaggcactagccgagcggtgcttagctgctctgactgaatgcgctgccagtggtgatgggaatattctggcgctggcagtcgatgctagtcgagcccgatgtaccgtgggagaaatcacagacgctctgaaaaaggtcttcggagaacataaagctaatgaccgcatggtcagcggtgcataccgacaagaatttggggaaagcaaggagattaccagcgctatcaagagggtgcacaagtttatggagagggagggcagaaggcctcgtcttctcgtcgccaagatgggtcaggacgggcacgatcgcggtgctaaagtgatcgccacaggctttgcggatctcggctttgatgtcgatattggtcccctctttcaaaccccacgcgaggttgcacagcaagctgtcgacgctgatgtgcacgcggtgggcgtgtccacgctagccgcaggacataaaacactggtaccagaactgattaaggaactgaatagtctcggacgtccagacattctcgtgatgtgtggtggagtgatacccccacaagattacgagttcttgtttgaggtgggggtgtctaatgttttcggtcctggcacaagaatccccaaagccgctgtgcaggtgctggacgatatcgagaagtgcctagagaaaaagcaacaaagcgtc

SEQ ID NO: 63 - DNA, 2250 bp, Artificial Sequence
  Codon optimized sequence that encodes an MCM polypeptide with the I671V mutation
atgcttcgggctaaaaatcagctttttttgctgagcccccattacttacggcaggttaaagagagttctggatctaggttaatccaacagagattgctgcaccaacaacagcctctacacccagagtgggccgccttggcgaagaagcagctgaaaggaaagaatccggaagatctcatctggcacacccctgagggcatctctataaaacctctgtattccaagcgcgacactatggacctgccagaggagcttcctggtgtgaagcccttcacacgcggcccgtatcctactatgtatacattccgtccatggaccattagacagtatgctggcttttctacagtggaggaatctaataaattctacaaagataacattaaggccggacagcagggcctaagtgtggctttcgatctcgccacccatcgcggatacgatagtgacaaccctagggtccgtggagatgtgggcatggccggcgtcgcaatcgatactgtggaagacacaaaaatactttttgacggaatcccacttgagaaaatgtcagtttctatgaccatgaacggggccgtcattcccgtactggcaaatttcattgttaccggggaggagcagggagtgccgaaagagaagcttaccgggaccattcaaaatgatatcctgaaggagttcatggttaggaatacttatatcttcccacctgagcccagcatgaaaattattgcggacatctttgagtacaccgcaaagcatatgcctaagttcaattcgatctccattagcggatatcatatgcaggaggcaggcgcggacgctattttggaactggcgtatacccttgccgacggccttgaatactctaggacaggactgcaggctgggctcaccatcgacgagttcgccccccgccttagctttttttggggcattgggatgaacttctatatggagatagccaaaatgagggcgggtcggaggctgtgggcccacctaatagaaaaaatgttccagcccaagaatagtaaatcattgctgttgagggcgcattgccagacttctggatggtcactgacagaacaggacccctacaataacattgtgcgcaccgcaatcgaagcgatggccgcggtgttcggtggaacccagagtctgcacacgaattctttcgacgaagcactcgggctgcccaccgtgaagtcagctaggatcgcacgcaacacacagataatcatccaggaggagagcgggatccccaaagtcgctgatccctggggtgggagctacatgatggagtgtctgacaaacgatgtttatgatgcagcactgaagctaattaatgagatcgaagagatgggtggcatggccaaggccgtggccgaagggatacccaaacttcgcattgaagaatgcgctgccaggcggcaggcgaggatcgacagcgggtccgaggtgattgtgggggtgaacaaatatcagctcgagaaagaggatgcggtggaagttttggcgatcgataacacttctgtacgaaatcgtcagattgagaaattgaagaaaatcaagagctctagggatcaggctctcgctgaaaggtgtcttgccgcattaacagagtgcgccgcgtcaggagatgggaacatcctcgccctcgccgtggacgcttcacgcgctagatgtacggtgggagagatcaccgacgcactgaaaaaagttttcggggaacataaggctaacgaccgaatggtaagcggtgcctatcgacaggaattcggcgaatccaaggagatcacatcagccatcaaaagggtccataagtttatggagagggagggaagacgccctcgactgctggtcgccaagatgggacaggatggccacgaccgaggagcgaaggtgatagccaccggcttcgccgatctgggcttcgacgtggacatcggccccttattccaaactcccagggaggttgcccaacaggcagtggacgcggatgtacatgcagttggagtctctacgctcgccgctgggcacaagactcttgtgcccgaactcattaaggagcttaattccttgggtcgtccagatatcttagtaatgtgcggtggggttattcctcctcaggactatgaatttctctttgaagtgggcgtctcaaatgttttcgggcctggcacacgaattccaaaggcagcagtgcaagtactcgacgacatcgagaagtgcttggaaaagaaacagcagagcgtt

SEQ ID NO: 64 - DNA, 2250 bp, Artificial Sequence
  Codon optimized sequence that encodes an MCM polypeptide with the I671V mutation
atgttgagggccaagaatcagctgtttctgctgtccccccactacctccgacaagtaaaggagagttctggaagcagattgatccagcagcggctcctccatcagcagcagcctcttcacccagagtgggcggccctcgccaagaagcagcttaagggaaagaacccagaggatctcatctggcatacacccgaagggatcagcatcaaacccctgtactccaaacgggacacaatggacctgcccgaggagctccctggggtgaaaccatttactaggggcccttatcccacaatgtatacttttaggccctggactataaggcaatacgccggattctccactgtagaggagagcaacaagttctataaggacaatatcaaagccggacaacaggggctcagtgtggccttcgatttagccactcaccgcggttacgattccgacaatccacgggtgcgtggcgacgtcggaatggccggagtagccatcgacacagtggaggacacaaagatcctgttcgatggtatccctcttgaaaagatgtctgtgagcatgactatgaacggcgccgtgattcccgtgctggctaacttcatagtcaccggggaagagcagggagtccccaaggagaaactaaccggaacaatacagaatgatatacttaaagaattcatggtcagaaacacctacattttccctccagagccatcaatgaagattatcgccgatatctttgagtatactgccaagcacatgcccaaattcaattccatatctattagcggttaccatatgcaggaagcaggcgcggatgcgatcctggaactggcttacacgctggccgacgggctcgagtattcacgcacagggctgcaggcagggttaaccatcgatgagttcgcccccaggctttcttttttctggggaatcggaatgaatttttatatggagatcgccaagatgagggcggggcggaggctttgggctcatctgatcgaaaaaatgtttcagcccaaaaattcaaagtctctgttgcttagggctcactgtcagacaagcggctggagccttaccgaacaggacccttacaacaatattgtgcggaccgctatagaggcgatggctgccgtgttcggcggaacccagagcctgcacaccaactccttcgatgaagccctgggccttcctacagtgaaatccgcccggatcgctagaaacactcagatcatcatacaggaggagtctgggattcccaaggtggccgatccctggggaggtagctacatgatggagtgccttaccaatgatgtatacgatgccgccctgaaactgattaatgagattgaagagatgggtgggatggcaaaggctgttgccgaaggtattcccaagctgcgcattgaggaatgcgcagcaaggcggcaggcaagaatcgacagtgggagcgaggttatagtgggggtgaacaaatatcagctggagaaagaagatgctgtagaggtcctggcgatagacaacacaagcgtgcgcaaccgacagattgagaaacttaagaaaattaagagttcccgggatcaagccttagccgagcggtgtctcgcagcactgaccgaatgtgctgctagcggggatggaaacattctggctttggcagtggatgccagcagggctcgttgcacagtcggcgaaatcaccgatgccctgaagaaagtgttcggggaacataaggctaacgatcggatggtgtccggcgcctatcgccaggagttcggggagagcaaggagattacaagcgccattaaaagggtgcataagttcatggagcgcgagggaaggcgacctaggctgctcgtcgcaaagatgggccaagacggtcatgacaggggcgctaaagtcattgccaccggcttcgctgatctcggatttgacgtggatatcggccctctgttccaaactccacgggaggttgcccaacaagctgtggatgccgatgtgcatgccgtaggcgtcagtacgctcgctgccggccacaagactctcgtgccggagctgattaaggaactgaattccctcggcaggcctgacattttggtcatgtgcggaggagtcatccctccacaggattacgagtttctgttcgaagtgggcgtgagcaacgtgtttggccccggaacgcgaatccccaaggccgccgtgcaggttctcgatgacatcgaaaaatgtttggaaaaaaaacagcaaagcgtt

SEQ ID NO: 65 - DNA, 2250 bp, Artificial Sequence
  Codon optimized sequence that encodes an MCM polypeptide with the I671V mutation
atgcttcgggccaagaaccagttgtttttgctaagtccacattatcttagacaggtcaaggagagcagcggatcccggcttatccagcagcggctgttacatcagcaacagccgcttcatccagagtgggcggctcttgccaagaagcagctgaagggtaagaaccctgaagacctaatatggcacacacctgagggcatctcaatcaagccactctatagcaagagagatacaatggaccttcctgaggagctaccgggtgtgaagccctttactagggggccctaccccaccatgtacacctttcgcccatggaccattcgccagtacgctggcttctccactgtcgaggaatcgaacaaattttacaaagataatattaaagctggtcagcaaggcctttcggtcgctttcgatctggcaactcataggggctacgactcagacaaccctagagtgcggggcgacgtaggaatggcgggagttgccatcgatactgtggaggacacaaaaatactttttgatgggatcccattggagaaaatgtccgtgtcaatgaccatgaatggagctgtgatccccgtgctggccaacttcattgtgacgggtgaggaacaaggcgtcccaaaagaaaagttgactggaaccatccagaatgacattctgaaggaattcatggtacggaacacctacatcttccctccagagccatctatgaaaatcatagctgatatctttgagtataccgcgaagcacatgcccaagttcaactctatcagcatatccgggtaccacatgcaggaagccggcgccgacgccatcctcgagctggcctacactttggccgacgggctggagtacagtcggactggcctgcaagcgggattaacgatcgacgagtttgccccgcgcctttcatttttttgggggatcggtatgaacttctatatggagatcgctaaaatgcgtgcagggcgaagactttgggcccaccttatcgagaagatgtttcagcccaagaactcaaagtccctccttttaagggcacactgtcagacatcaggatggtcccttactgagcaggatccttataacaatattgtgcgaaccgcaatcgaggccatggcagccgtgttcggaggaactcagagccttcacacaaattccttcgatgaagcactgggccttccgaccgtgaaaagtgccagaattgccaggaacacccagattataattcaagaggagagcggcatcccaaaggttgccgatccctggggtggcagttacatgatggagtgtttgactaacgacgtttatgatgctgccttaaaactgatcaatgaaatcgaggaaatgggcggtatggccaaagctgtggcagagggcatccccaagctacggattgaagaatgcgctgcccgaagacaggcaaggatcgactcaggatcagaagttattgtgggcgtcaataaataccagctagagaaggaggatgcggtagaagtcctggccatcgataatactagcgtgcggaaccgccagattgagaagctcaagaaaattaaatctagtcgcgaccaggccctcgcagaaaggtgccttgcggctctcaccgaatgtgcagcgtcaggcgacggtaacatcctggcgctggccgttgatgccagtcgagctaggtgcactgtgggagaaattacagacgctctcaagaaagttttcggcgagcacaaggcgaatgaccgcatggtgtcgggcgcctatcgccaggagttcggagagagcaaggagattactagcgccattaaacgggtacacaagttcatggaacgcgaggggagacgtccacggctgctggtagccaaaatgggacaggacggacacgaccgcggagccaaagtgatcgcgacgggcttcgccgatcttggtttcgatgtggacattggcccgctcttccagacaccaagagaggttgcacagcaggcagtggatgcagacgtccacgctgtgggcgtcagcacgcttgccgctgggcacaagaccttggtccctgaactcatcaaagagttgaatagcctgggccggcccgacatcttggtgatgtgtggtggggtaatacccccccaggattacgagttcctgttcgaagtcggagtatcgaatgttttcggtcccggaacgagaattcctaaggctgctgtgcaagtgctggatgatatagagaagtgtcttgagaagaagcagcagagcgtc

SEQ ID NO: 66 - DNA, 2250 bp, Artificial Sequence
  Codon optimized sequence that encodes an MCM polypeptide with the I671V mutation
atgctgcgtgctaagaatcaactgttcctgctatctccccactatctgagacaagtgaaggagtcttccggatctcggttgattcagcaacgcctgctgcaccagcaacagcctttgcatcccgaatgggccgcactggcgaaaaaacagctgaagggcaagaatccggaagacctcatttggcacactccagaaggcatcagtatcaaacctctttattctaaacgagataccatggacctgcccgaagaactgcccggagtaaagccttttacccgcgggccatatccaactatgtacacttttaggccgtggactatcagacagtatgcgggctttagcaccgtcgaggagtctaataagttctacaaggataacattaaagccggccagcagggactgagtgtggcttttgacctagcgacacaccgcggctatgactcagacaatccccgagtgcgtggcgacgttggcatggcgggagtagccatcgacacagtggaagatacaaagatccttttcgatggcatcccactggagaagatgagtgtaagtatgacgatgaacggagcagtgataccagtcctcgccaactttatcgtgacgggtgaggagcagggtgtgccaaaagaaaagctgaccggaacgatccagaacgatatcctgaaggagttcatggtgcgaaacacatatatcttccctcccgagcctagtatgaaaatcattgctgacatcttcgaatataccgccaaacacatgcccaagttcaattctatctctatcagtggctaccatatgcaggaagccggagctgacgccatactcgaactggcttatacactcgccgacggtctcgaatactccaggactggcctacaagccggactgacaatcgatgaatttgctccacggttatcttttttctgggggattggcatgaacttttacatggaaatagccaaaatgagggccggccggaggctttgggcccatctgatcgagaagatgttccagcccaagaatagtaaaagccttcttctaagagcccactgccagacttctgggtggtctctcactgagcaggatccctacaataacatcgtcagaaccgctattgaagccatggccgccgtgtttggcggcacccaaagcttgcacacgaacagctttgacgaagcactcgggctaccgacagtgaagtccgcccgcattgctcggaacacccagattattatccaagaagaaagcggaattcctaaggttgccgatccctggggcggctcatatatgatggaatgtctgacgaatgacgtctacgatgcagcgctgaagctgattaacgagatcgaagaaatgggaggcatggccaaggctgtagctgagggcataccaaagctgcgcattgaggagtgcgccgcccggcggcaggcccgaatcgactccggtagcgaagtcatcgttggagttaataagtatcagttagaaaaggaggatgctgtggaggtgctggcaatcgacaataccagcgtgcggaatcgccagattgaaaaactcaagaagatcaaatcctcccgagaccaggccttggccgagcggtgcttggcggccttaacagagtgcgcggccagtggcgatgggaacattctagcactcgccgttgacgctagccgtgcaaggtgtacagtcggcgagatcacagacgctttgaagaaggtgttcggcgagcataaagcaaatgaccgcatggtgtctggcgcatatcgccaagagttcggagagtctaaggaaatcacctccgccatcaaaagagtgcataaattcatggagagggaagggcgccgcccacgtctgttagtggccaaaatggggcaagacggtcatgaccgaggggctaaagtgatagccacaggctttgctgatctgggatttgacgtggacataggccccctgttccagacgccaagggaagtcgcacagcaggctgtggatgcagacgtgcatgccgtgggggtgtctacactggctgccggacataagactcttgtgccagaactgattaaggagttaaatagtctgggacgcccagacattctggtaatgtgtggaggggtgatccctcctcaggactacgagtttctgtttgaagtgggcgtgagcaacgtgttcggacccggtacccgcattcccaaggcggcagtgcaggtgcttgatgatatcgaaaaatgccttgagaagaaacagcagagtgtg

SEQ ID NO: 67 - DNA, 2250 bp, Artificial Sequence
  Codon optimized sequence that encodes an MCM polypeptide with the I671V mutation
atgttacgggctaagaatcagctgttcctcctctcgccccattatctgcgccaggtcaaagaaagctccgggtctagattgattcagcagagactcctgcatcagcagcagcctctgcaccccgagtgggcagccctagcgaagaaacagctaaagggcaagaaccccgaggatctgatatggcacactcccgaagggatctcgatcaagcccctctattcgaagcgggacacaatggacctcccagaggagctccccggagtaaagcctttcactaggggcccatacccaaccatgtacactttccgcccttggactatacggcagtacgccggcttttccacagttgaggaaagcaacaagttctacaaggataatatcaaagccggccaacaagggttgtccgtggcatttgacctggcgactcacagggggtacgactctgataatcctagggtgcggggcgacgttgggatggccggggttgcgatcgataccgtggaggacactaaaatattgttcgacggcatcccattggagaagatgagcgtgtcaatgacaatgaacggagcagtgatacctgttcttgccaacttcattgtgaccggtgaagagcagggagtaccgaaggagaaactgacaggcaccatccagaatgacatccttaaagagtttatggtcagaaacacctatatattcccacctgagcctagtatgaaaatcatagcagacatttttgaatacacggccaaacatatgccgaagtttaactcaatcagcatctctgggtaccacatgcaagaggcaggtgccgacgctatcctggaactggcatacacgcttgcagatggtttagaatactccagaacaggattgcaggccggactcacaatcgacgaattcgcccctagactctccttcttctggggaattgggatgaatttctacatggaaattgccaaaatgcgggccggccgacgcctttgggcgcacttgattgagaagatgttccagcctaagaactcgaagtcgttactgctcagagcgcactgccagacatcggggtggtctttaactgaacaggacccttacaataatattgtgcgcactgccattgaggccatggcggccgtattcggcgggacgcaatcgcttcacaccaatagttttgatgaagctcttgggttacctaccgtgaagtccgcaagaatcgcccgcaatacccagattattatccaggaggagagcggcattccgaaagtggccgatccatggggcggcagctatatgatggaatgcctcaccaatgacgtctatgatgctgctctcaaacttataaatgagatcgaagagatgggtggcatggctaaagccgtggccgaaggcattccgaaattgcggatcgaggaatgtgcagcgagacgccaggctagaattgatagcggcagtgaagtaattgtcggggtgaacaagtaccagttagaaaaagaggatgccgtggaggtgctggccatcgacaacacttctgttcggaacaggcaaatcgaaaagctcaagaaaattaagtcaagccgagatcaagctctggccgagagatgtttggctgccttgacagaatgtgctgcttcgggggatggaaacatcttggctctggctgtggacgcaagccgggcacgttgtactgttggagagatcaccgatgccctgaagaaagtgtttggagaacataaggcaaatgataggatggtgagcggggcgtatcgtcaagaatttggcgagtccaaggagatcacttcagctattaaaagagtccacaaatttatggaaagggaagggaggagaccgaggctactggtggccaaaatgggccaggatggacatgaccggggggctaaggttatcgccacaggattcgctgatttgggattcgacgtggatatcggaccactttttcagacacctcgcgaggtagcgcaacaggcagtggatgcagatgttcacgctgttggtgtgtctacactggctgccggtcataaaacgttggttcctgagttaataaaagaactgaactcattgggacgacccgacatcctggtgatgtgtggcggtgtcatccccccccaggattacgagttcctgtttgaggtcggggtgtccaatgtctttgggcccgggaccagaattcccaaagctgccgttcaggtgttggacgatattgaaaagtgcttagaaaaaaagcagcagtcagtg

SEQ ID NO: 68 - DNA, 2250 bp, Artificial Sequence
  Codon optimized sequence that encodes an MCM polypeptide with the I671V mutation
atgcttagagccaagaatcaactgttcttactctcaccacactatctcagacaggtgaaggaatcaagcggaagtagactgattcagcaacgactattgcaccagcaacagccactgcaccccgagtgggcagcactcgccaagaagcagctgaaggggaaaaaccctgaagacctcatttggcatactccagagggcatctcaatcaaaccactgtattcaaaacgggacacgatggacctacccgaagagttaccaggagtgaagccgttcaccaggggaccatatcccacgatgtacaccttccggccatggacaattcgccagtatgccggtttctctaccgtcgaagaatcaaataagttttataaggataacatcaaggccggccagcagggactgtctgtggcctttgatcttgcaactcaccgcggctacgattcagataatccccgcgtgcggggtgacgttggtatggctggcgtggcgatcgatacagttgaggacaccaagatcctgttcgacggaatccctctggaaaaaatgagcgtctcaatgacgatgaatggtgccgtgatcccagtgctggccaacttcattgtcacaggcgaggaacagggtgttccgaaagagaagctgacaggcaccatccagaatgatatcctgaaagagtttatggtgagaaatacttatatcttccctccagaacccagcatgaagattattgccgatattttcgaatacacagccaaacacatgccaaaattcaattcgatctctatctcaggttatcacatgcaggaggcgggggctgatgccatcctggaactggcatacactttagccgacggattggagtactccaggactggcctgcaagcaggactaactattgatgagtttgccccaaggttgagctttttttggggcattgggatgaacttttacatggagatcgcaaagatgagagctggcagaagactatgggcccatctgatcgagaaaatgtttcagccgaaaaactcaaagagcttactgttgcgagcgcattgccagacatccggctggtcattgacagaacaagacccctataacaacatcgtgcggacggccattgaggccatggcggccgtgtttggagggacacaaagcttgcacaccaacagtttcgacgaggccctgggcctccccacagtgaaatcagcgcgaatagccaggaatacccaaatcatcatccaggaagaatctggtatcccgaaggtggcggacccctggggcggatcctacatgatggagtgtcttaccaacgatgtgtacgatgcagccctgaaactcatcaatgaaatcgaagagatgggaggcatggccaaggccgtggccgaagggatcccgaaattgaggatcgaggagtgcgccgctagacgccaggcgcgcatcgactccgggtccgaagtcatagttggcgtcaataaataccagctggaaaaagaagatgccgtagaggttttagcaattgacaataccagtgtgaggaaccgccagattgagaagttgaaaaagatcaaaagctcgcgagatcaggcccttgccgagcgctgcctagctgccctcactgagtgcgccgcttcaggcgacggcaacattctggctctcgctgtcgacgccagtcgagctagatgcaccgtcggtgagatcactgacgccttgaagaaggtgttcggggaacacaaggcaaatgaccgcatggtttcaggggcttacagacaggagtttggggagtctaaagaaattaccagtgccataaaacgcgtccacaaattcatggaaagagagggaagacggcctcggctgttagtggcgaaaatgggccaggacgggcatgaccggggcgccaaagtgattgctaccggttttgcggacctgggctttgatgttgacataggacctctgttccagactccccgcgaggtcgcacagcaggccgtagacgccgacgtacacgcagtcggtgtgagcacattggctgccggccacaagaccctggttcccgagttgatcaaagagctgaacagtttgggtcgacctgatatcctcgttatgtgtgggggggtgatacccccccaggactacgaatttttgttcgaggttggggtcagcaatgtgttcgggccgggcacaaggatccccaaggcagccgtacaggttctcgacgatatcgaaaaatgtctcgaaaagaaacaacagtctgtg

SEQ ID NO: 69 - DNA, 2250 bp, Artificial Sequence
  Codon optimized sequence that encodes an MCM polypeptide with the I671V mutation
atgctgagagccaaaaaccaactgtttctgctctctcctcattatctgcgccaggtcaaagagtcatctggaagcaggttaattcagcagaggctgctgcaccagcagcagccccttcatccagagtgggctgctctggctaagaaacagctgaagggtaagaatccggaagacttgatctggcacaccccagagggcataagcattaagcctctttatagtaagcgtgatacaatggacttacctgaagaactacccggtgtgaagccatttacaagaggcccgtatcctacaatgtatacatttcgcccgtggaccatcaggcagtacgcgggcttcagcaccgtagaagagtcaaacaaattttataaggataatattaaagccggacagcaagggttgtccgtggcgtttgacttggcaacacaccgcggctacgactcagacaaccctagggtcagaggcgacgtaggcatggccggggtggccatcgacacggtcgaggacacaaagatcctgttcgatggcattcccctggagaagatgagtgtctctatgacaatgaacggggccgtgattcccgtgctcgcaaactttatcgtgacaggggaggagcagggagtacccaaagagaagctcaccggtaccatacaaaacgatattctgaaggagtttatggtaaggaacacgtatatctttccaccagaaccatccatgaagattattgctgatatttttgaatacactgcaaaacacatgcccaagttcaatagcatctcaataagtggctatcatatgcaagaggctggcgcagacgccattctggaactcgcctataccttggccgacggtttggagtactcccgcaccgggctccaggctggcctgaccattgacgagtttgcgcccaggcttagttttttctggggtattggaatgaatttttacatggagatcgccaagatgagggcaggcaggagactctgggcgcatctgatagagaagatgttccagcctaaaaattccaagtccctgctgctgagagcccattgccaaaccagcggttggtctctgactgaacaggacccgtataataatatcgtgagaacagctatcgaagctatggcagccgtcttcggaggaacacaatctttgcacacgaatagcttcgacgaggcactgggattgcccactgtgaagagcgcccggattgcacgaaacacccaaatcataatccaggaggagtctggcatcccgaaggttgccgacccttggggcgggtcctacatgatggagtgcctgacgaacgatgtgtatgatgctgccctcaagttaataaacgagatcgaggagatgggtggcatggccaaagccgtggctgagggaattcctaaactgcggattgaagagtgcgcagcacggagacaggcccgaattgactctggatctgaagtgatcgtcggagtcaataagtaccagctggagaaagaagatgctgtggaagtcctggccatagacaacaccagcgtccggaatagacagatcgagaaactgaaaaaaataaagagtagcagagatcaggctcttgctgagcggtgtttagccgctctgaccgagtgcgcagcgagcggcgatggaaatattctggctctcgctgtagatgcttcaagagcaaggtgcactgtgggcgagatcactgacgcgttaaagaaggtcttcggcgagcacaaagcgaatgacagaatggtgtccggcgcatatcggcaagagtttggagagtctaaggagataacgagcgcaataaaacgggttcacaaatttatggaaagagaaggccgccgcccacgtctgctggtagcaaagatgggccaggatggccatgaccgcggcgcaaaagtgattgcaaccgggttcgctgatcttggcttcgatgtggacattgggccactgttccagacacctcgggaagtggctcagcaagcagttgatgcagacgttcacgcagtcggtgtgtccacgctcgccgccggacataagactctcgtgcccgaactgatcaaagaactaaattccttgggcaggccagacatcctggtgatgtgtggcggcgtaattcctccccaggattacgagtttctcttcgaggtgggcgtgtccaatgtcttcggcccagggacgcgtatccctaaggctgccgttcaggttctcgatgacatcgaaaagtgcctcgagaaaaagcagcagtcagtt

SEQ ID NO: 70 - DNA, 2250 bp, Artificial Sequence
  Codon optimized sequence that encodes an MCM polypeptide with the I671V mutation
atgctgcgggctaagaatcaactgtttctgctgtcaccacattacttgaggcaggttaaggaatctagcggaagcaggttaatacagcagaggttattgcaccagcaacaacccttgcatcccgagtgggccgcgttagccaaaaagcagcttaagggcaaaaatcccgaggacctgatctggcatacaccagagggcattagtataaagccactctattctaaaagagatacaatggacctcccagaggagctgcctggagtcaagccctttactcggggcccgtatcccaccatgtatacattccggccctggaccatccggcaatatgccggattcagtactgtggaagaatcgaacaaattctataaggataacatcaaggccgggcaacagggactgagcgtggcattcgacttagctacccacagaggctacgacagcgataatccaagagtccggggcgatgtgggtatggcaggcgtggccatcgacactgtcgaggacactaaaatcctcttcgatggaatacccctcgagaagatgtcagtgtccatgactatgaacggcgcggtgatcccggtgctggctaactttatcgtgacgggggaggagcagggcgtgcctaaggagaaattgaccgggaccatccaaaatgacattctaaaagagttcatggttagaaatacctacattttcccccctgagcccagcatgaagataattgccgatatttttgagtatactgccaaacacatgccaaaatttaactcaatcagcatttcagggtatcatatgcaggaggccggcgctgatgcaatcttagaacttgcttatactctggctgacggcctggagtatagtcgaactggactacaggctggattaactattgacgaatttgctccacgcctgagcttcttttggggcattggcatgaacttctacatggagattgccaaaatgagagcaggacggcgactgtgggcacaccttatagagaaaatgttccagcccaagaattccaaatcgctactgcttagagcgcactgtcagacctccggatggtcgctgaccgaacaggacccgtacaataatattgtgaggactgccatcgaggccatggcggctgtctttggggggacgcaatcgctacatacgaattctttcgacgaagctctcggcctgccaacagttaaatcagctcgcatcgccagaaacacccagatcatcattcaggaggaaagcgggattcccaaggtggctgacccttggggaggatcatatatgatggagtgtctgaccaatgacgtatacgacgctgcacttaagctcatcaatgagattgaggagatgggcggcatggctaaagctgtagccgaagggattccaaaactgaggatcgaagagtgcgccgcaaggcgacaagcacgtatagattctggtagtgaggttatcgtgggcgtgaataagtaccagctggagaaggaggatgccgttgaggttctggccattgacaacacgtctgtacgcaatagacagattgagaaacttaagaaaatcaagagcagtagagatcaggctctggctgagcgctgtctggcggcactcactgagtgtgcggcctccggtgacggcaatatactggcactggcggtggatgcgagcagggcacggtgcaccgttggagaaattacggacgccctcaaaaaggtgttcggcgaacataaggcgaatgatcggatggtgagcggtgcctaccggcaggagttcggcgagagcaaggagatcacgtccgccattaagagagtccataaattcatggaacgagagggccgccggccaagactgctggtggctaagatgggacaggacggacacgaccgtggggctaaggtcattgccacagggtttgccgatcttggcttcgatgtggatatcggccctttattccaaacacctcgggaggtggcccagcaagcagtggatgctgatgtacatgccgtgggtgtgtctacgcttgccgccggccataagaccctggtccctgagttaattaaagaactgaatagtctgggcagacctgatatacttgtaatgtgcgggggagtgataccgcctcaggactacgaatttctgttcgaggtcggcgtcagtaatgttttcgggcctggcacacgcattccaaaagccgccgtacaggtcttggatgatattgaaaagtgcctggagaagaagcagcagagcgta

SEQ ID NO: 71 - DNA, 2250 bp, Artificial Sequence
  Codon optimized sequence that encodes an MCM polypeptide with the I671V mutation
atgctgcgtgccaagaaccaattgtttcttctgagcccccactatctcagacaggtgaaagagagctcggggtcacggctgatccagcagagactactgcaccagcagcagcccctacaccccgagtgggctgctctggccaagaaacagctgaagggcaagaaccctgaagacctgatctggcacacccctgaaggcatttcaatcaaacccttgtacagcaagcgagatactatggacctgccagaggagctccctggcgttaagccttttacacgggggccctatcccaccatgtacacattccgtccctggaccatcaggcaatatgcaggcttcagcacagttgaggagagcaataagttctacaaagacaacatcaaagccgggcagcagggccttagcgtggcatttgatctggccacccataggggttatgacagcgacaatccccgtgttcgcggcgacgtgggtatggccggcgtagcgattgacacagtcgaggacactaagatcctattcgacggaatcccgctggaaaagatgtctgtgtctatgaccatgaatggggcagtgatccctgtgctcgctaacttcatcgtcaccggggaagaacagggcgtgcccaaagagaagctgaccggaacaattcagaacgatatcctcaaagagttcatggtgcgcaatacctatatttttccccctgaacctagtatgaaaattatagccgatatctttgaatataccgcaaaacatatgcctaagtttaactccatctcaattagcgggtaccacatgcaagaagccggggccgacgctatcttggagctggcatataccttggccgacggactggaatattctcggaccgggcttcaggccggtcttaccattgacgagtttgcaccaagactctcatttttctggggcatagggatgaacttctacatggagatagctaaaatgagagccgggcgacgcctatgggcccaccttattgaaaaaatgtttcagcctaagaattctaaatccttgctgttgcgggcccactgccagacgagcgggtggagcctgacggagcaggacccctataacaacatcgtgaggacagcaatagaggccatggccgcagtgttcgggggcacccaaagcctgcacacaaactcctttgatgaggcactcggtctccccacagtcaaaagcgcgcggatcgccagaaatacccagataattattcaggaagagtcgggtattccaaaagtggcagacccgtggggagggtcttatatgatggaatgcctgactaacgatgtgtatgacgcagccttgaagctgataaatgaaatagaggagatgggtggaatggcaaaagccgtcgcagagggtattcccaagctccggattgaagagtgtgccgcacgcaggcaggctagaatagactctgggtctgaggtcatcgtgggagtcaataaataccagctggaaaaggaagatgccgtggaagtgctagctatcgacaatacaagcgttagaaatagacagatcgaaaagctgaaaaagattaagtccagccgtgaccaggcactggctgagcggtgcctggccgcactgacagagtgcgccgccagcggagatggcaatattctggctctggcagtggatgcatccagggcacggtgcaccgtgggagaaatcaccgacgccctcaagaaggtgttcggagagcataaggccaacgacaggatggtgagtggtgcgtatagacaggaattcggggagagtaaggagatcacctcagccataaagagggtccacaagtttatggagagagaagggagacggccccgactgctcgtcgcgaagatggggcaggacgggcacgatcggggggcaaaggttattgccactggctttgcagacttaggcttcgacgtggacatcggcccacttttccagacaccccgggaagtcgcccagcaagcggtggacgcagacgtgcacgctgtgggcgtcagcacactggctgccggtcacaaaaccctggtaccggagctaataaaagagctcaattcgctgggacgccccgacatccttgtgatgtgtggtggtgttattcctccgcaggactacgaatttttgttcgaagtcggcgtgagcaacgttttcgggccaggtaccagaatccccaaagctgcagtacaggtactggatgatattgagaagtgcctggagaagaaacagcagagcgtg

SEQ ID NO: 72 - DNA, 2250 bp, Artificial Sequence
  Codon optimized sequence that encodes an MCM polypeptide with the I671V mutation
atgctgcgagccaaaaaccaactcttcctgctgagccctcactatcttcggcaagttaaggagagctctggctcccgactgatccagcagagactgctccaccagcaacaaccacttcatccggaatgggccgcgctggccaagaagcagctaaaggggaagaaccccgaggacctgatctggcacactccggaagggattagtatcaaacccttatatagtaagagggatacaatggatcttccggaggagttaccaggagtgaaaccttttacccgcggcccctatcccactatgtacactttcaggccttggacgattaggcaatatgctggattttccacagtggaagaatctaacaagttctataaagataatattaaagcggggcagcagggcctgtcagtggctttcgatttagcgacacaccgcggctacgattcagacaacccgagagttcgaggggatgttggaatggccggagtggccatagacactgtcgaggacactaagattctgtttgatgggatccctcttgagaaaatgtctgtgagtatgacaatgaatggagctgtgatccctgtgctggcgaacttcatcgtcactggcgaagaacagggtgtacctaaagagaagctgacgggcactatccagaacgatatactgaaggagtttatggtgcgcaacacttacatcttcccaccagagccctctatgaagatcatcgccgatatctttgagtatacagctaagcatatgcctaaattcaacagtatcagtatatctggatatcacatgcaggaagccggtgccgacgcgattcttgagctggcctacaccctggccgacgggctcgagtacagcagaacgggtctgcaagcaggactgactatagacgaattcgccccccgattatcattcttctggggtattgggatgaatttttacatggaaatagctaagatgagagctggtcggaggctgtgggcgcacttgatcgagaagatgtttcagccaaaaaattctaagtctctcttgttgcgcgcgcactgtcagacttcaggatggagcctgaccgagcaggatccttacaataatatcgttcgcacagcaatcgaggcgatggctgctgtgttcgggggcacccaatccttgcacaccaattccttcgatgaagctcttgggctgccaaccgtcaaaagcgctcggattgctaggaacacacagattatcatacaagaagagtcgggcatccctaaagttgccgatccgtggggtgggtcttacatgatggagtgtctgaccaatgacgtctacgatgccgcactgaaactgatcaacgaaatcgaggaaatgggggggatggcaaaagcggtagctgagggcatccccaaattgcgtatcgaggagtgcgccgcaaggagacaggccagaattgattcaggaagcgaagtaatagtaggcgtcaataagtaccaattggaaaaggaggacgcggtcgaagtgctggctattgacaacacctccgtgaggaatcgccaaatagagaaactcaaaaagatcaaatcttccagggatcaggccctggccgagcgctgtctcgccgctttgaccgaatgcgccgcttccggcgacggtaacatcttagcgcttgccgtggacgcatctcgcgctcgatgcacggtgggcgaaataaccgatgcattgaagaaggtctttggcgagcacaaggcaaacgatcggatggtgtctggtgcctatcgtcaggagtttggcgaatccaaggaaattacctctgctataaagcgagtacacaagtttatggagcgggagggccgccggccccgactgctggttgcgaagatgggacaagatgggcatgatcgcggcgctaaagtgattgcaactggcttcgcagacctgggcttcgatgttgatataggtccactcttccagacaccacgcgaagttgctcagcaggcagtggacgctgatgtccatgccgtgggggttagtacattagctgctgggcataagacccttgtcccggaattaattaaggaactgaacagcctggggaggcctgacatcctggtcatgtgcggcggggtgatccccccccaggactacgagtttctgttcgaagtgggagttagtaatgttttcggacccgggacccgcattcctaaagcagcagtccaggttctggatgatattgagaagtgtctggagaaaaaacagcagtccgtc

SEQ ID NO: 73 - DNA, 2250 bp, Artificial Sequence
  Codon optimized sequence that encodes an MCM polypeptide with the I671V mutation
atgctgagagcaaaaaaccagctcttcctgctgtcgccccattatctgcgacaggtcaaggagtcgagcggcagtaggctcatccaacagcgcctgctgcatcaacagcaaccccttcaccctgagtgggcagccctggccaagaagcagctcaaaggcaagaaccctgaggatctgatttggcatacacctgagggtatttctattaaaccactgtactcaaaaagagacacaatggatctccccgaagagcttcccggagtgaagccttttactaggggaccttacccaacgatgtatacgttcagaccctggacaattcgtcaatatgcaggattctccacggtggaagaatcgaacaaattttacaaagataacatcaaagcgggacagcaggggctcagcgtggcgttcgatctagcgacccatcgcggatacgactcggacaaccccagggttcggggggacgtgggcatggccggcgtggccatagatacagtcgaggacaccaaaattctgtttgacggcatccccctggaaaaaatgagtgtttcaatgacgatgaacggggccgtcatccccgtactggcaaacttcatagtgacaggggaagagcagggcgtgccaaaggagaagctcacagggaccatccaaaatgacattctaaaagagttcatggttcgaaacacctacatcttcccccccgagccttctatgaagattatagctgatatctttgagtacactgcgaagcacatgccaaaattcaactctatctctatcagtggataccatatgcaggaggcaggtgctgatgccatcttagaattagcctacaccttggctgacgggctcgagtacagccgaaccggcctgcaggctggactcacaattgatgaattcgctcctagactcagcttcttctggggaattggcatgaatttctatatggagatcgcgaagatgcgagctggccgcaggctctgggcccatctcatagaaaagatgtttcaacctaaaaatagcaagtcactgttattgcgcgcccactgtcagacgtccggctggagcctgacggagcaggacccatacaacaatattgtcagaacagcaatcgaagctatggcagctgtgttcggtgggacacaatctctgcatactaatagttttgacgaggcgctcgggttgcccacggtcaaatctgccagaatagcgcgcaacacccagatcattatccaggaagagagcggtattcctaaagtagccgacccttgggggggcagctacatgatggagtgtctgaccaacgacgtttacgatgctgctctgaaattgatcaatgaaatcgaagagatgggcggaatggctaaggctgtcgctgaagggattcctaaattgagaattgaggagtgtgcagccaggcgtcaggcccggatcgactctgggtctgaggtcattgtgggcgtcaataaatatcagttggagaaggaggacgccgtagaagttctggcaatcgataacaccagtgttagaaacaggcagatcgaaaaattgaaaaagattaagtcatcacgagatcaggccttggcagaacgttgccttgctgctttaaccgaatgtgccgcctcgggggatgggaatatcctggccctcgcggtagacgcatccagagcacgctgcaccgttggtgaaatcacagatgcgctgaagaaagtgtttggcgaacataaggcgaacgacagaatggtgagcggagcctaccgccaagagttcggcgaatccaaagagattactagcgcgatcaagcgagttcacaagtttatggaacgggagggcagaaggccaagactgctggtcgctaaaatgggccaggatgggcatgaccgtggcgctaaggtgatagctaccggctttgcagaccttggattcgatgtggacataggtcctctgtttcagactcccagagaggtggctcaacaggcagttgatgctgacgttcacgccgtgggcgtatcaaccttagccgccgggcacaaaacactcgtccccgaattgatcaaggaattgaattccctaggcagaccggacatcttggtgatgtgtggcggcgtgattcccccacaggactatgaattcctcttcgaagttggagtttccaacgtgttcggaccaggaacccgtattcctaaggcagctgtacaggtcctggatgacattgagaaatgcctggaaaagaaacagcaaagcgtc

SEQ ID NO: 74 - DNA, 2250 bp, Artificial Sequence
  Codon optimized sequence that encodes an MCM polypeptide with the I671V mutation
atgttgcgggcgaagaaccagctcttcttattgtccccgcactacctccgacaagtaaaagaatcctctggctcaaggctgattcaacagcgattgctccaccagcagcaacctttacatcccgaatgggctgctctggccaagaagcagctgaagggaaaaaaccctgaagacctgatctggcatacaccggaggggatttccattaagccgctctattcgaaacgagacacgatggatctgcctgaggagctgcctggggtcaaaccatttaccagggggccgtaccccacgatgtatactttccggccctggaccataagacaatacgccggcttctccaccgtggaagagtccaacaaattttataaggataacattaaggcgggacaacagggtctgtccgtggcatttgacctcgccacacatcgcggctacgattctgacaatccacgcgttcgcggggacgtgggcatggcaggcgtcgcaatcgacaccgtggaagataccaaaatcttgtttgacggcattccgttggagaagatgtctgtcagcatgaccatgaacggagcggtgattcccgtcctcgccaacttcatcgttacaggcgaggaacagggtgtccccaaggaaaaactgactggcaccatccagaatgacattctaaaggaatttatggtccgcaatacctacatcttcccacctgaaccgtccatgaagatcatcgccgatattttcgagtataccgccaaacatatgcctaaattcaacagcataagtatttcaggataccatatgcaagaggctggtgccgacgcgattctggaacttgcttacactctggcggacggcttggagtattctcgcaccggtctccaggcgggcctgacaattgatgagtttgccccaaggctgtcgtttttctggggtatcggtatgaacttctatatggagatcgcgaagatgagggccgggcggcgcctatgggcacacctgatcgaaaaaatgtttcagcccaagaatagcaaatcactgctgctacgggcccattgtcagacgtctggatggtccctcaccgaacaggacccctacaataacatagtgcgtaccgccattgaagcgatggctgccgttttcggaggcacccagtcccttcacacaaactccttcgatgaagccctgggcctccctacagtcaagtctgcccgcattgcacgcaatactcagatcattattcaggaagagtcaggaatccccaaggttgcagacccatggggtggcagttatatgatggagtgtcttacaaatgacgtctacgatgctgctctgaagctaatcaatgagattgaggagatgggagggatggccaaggcagtcgccgaggggattcccaaactcagaatcgaagagtgcgcagcaaggagacaggcccggattgattccgggtccgaagtgatcgttggtgtgaataagtatcaactcgaaaaagaggatgctgtggaggtcctggccatcgacaacacctccgtcaggaatagacagatcgaaaaattgaagaagatcaagtcatctcgcgaccaagccctggcagagagatgcttagcagccctaaccgagtgtgcagcctctggggacgggaacatcttggctcttgctgtggatgctagcagggcacgatgcaccgtgggggagatcacagatgccttgaagaaagtgttcggcgagcacaaagccaatgaccgaatggtaagcggggcttatagacaagaatttggggaatctaaagagataacctcggccatcaagcgcgtccataagttcatggagcgggagggacgcaggccccggctgctcgtagccaaaatgggtcaggacgggcacgataggggagctaaggtgatcgcgaccggctttgctgatcttggcttcgacgtcgacatcggaccactgtttcagactcctagagaagttgctcaacaggccgtagacgccgatgttcacgccgtgggggtgagcacactggctgccgggcataaaacactcgtgccggagctcatcaaagaacttaactcgcttggaagacccgatatcctagtgatgtgcgggggtgtaattcccccgcaggactacgagtttcttttcgaggttggagttagcaatgtgtttggacccggtacccggatccctaaagctgcggtgcaggttctggacgacattgagaagtgtctcgagaagaaacagcaaagcgta

SEQ ID NO: 75 - DNA, 2250 bp, Artificial Sequence
  Codon optimized sequence that encodes an MCM polypeptide with the I671V mutation
atgctgcgcgccaagaaccagttgttcctgctttctccacactacctgagacaggtcaaggagagcagcggatctagactcatccaacagagactgcttcaccagcagcagccgcttcatcctgagtgggccgcccttgccaagaagcaattaaaaggaaagaaccccgaggatcttatctggcatacgcctgaaggtatttcaatcaagcctctctatagcaaaagagacacaatggatctccccgaggagctgccaggggtgaaaccttttacgagagggccctatccaacaatgtatacattcaggccatggaccattcggcagtatgcaggcttttccactgtggaagagagcaataaattttacaaagacaacattaaggcgggccagcagggtttaagtgtggccttcgatttagccactcatcgcgggtacgattcagacaatcccagagtgcggggggacgtaggcatggcgggtgtcgcaattgacaccgtagaggacacaaaaattcttttcgacgggattccccttgagaaaatgagtgttagcatgactatgaacggggctgtcattccagtgctggcgaattttattgtgaccggcgaggagcagggggtacccaaggagaaactgacaggtaccatacagaacgacattttgaaagagttcatggtgcgcaacacatatatattccctcctgaaccatctatgaagattatcgcggacattttcgagtacaccgcaaagcatatgcccaagttcaactcaatctctatttctggctatcacatgcaggaagcaggggctgatgcgatactggagctggcctacacactggccgacgggcttgaatactcccggaccgggttgcaagcaggactaacgattgatgaatttgcgccgagactatctttcttttggggaattggtatgaatttctacatggagatcgccaagatgcgcgcgggcagacgcctctgggcccacctgatagagaaaatgttccaaccaaagaatagtaagtccctgctgttgagggcccactgtcagacctccggatggagtctgaccgagcaggacccatataacaacattgtgagaaccgcaatagaagccatggccgcagtcttcggtggcacacaatccctgcataccaactcttttgacgaagctttaggtctaccaaccgtcaagtctgctcgcatcgccaggaacactcaaataatcatccaggaagagtcgggaattcctaaagtggccgacccgtggggtgggtcatacatgatggaatgcctcaccaatgatgtgtatgacgctgctcttaaactgataaacgagatcgaggaaatgggcggaatggctaaagccgtggcggaaggtataccgaaactcaggatcgaagaatgtgcagctcggcggcaggctaggatcgactctggctcagaggtgatcgttggagtgaacaagtatcagctagagaaggaagatgctgtcgaagtgctcgcaattgacaacacaagcgtacgtaatagacagatcgaaaaactcaaaaaaatcaaaagctctcgagaccaggctctcgccgaaagatgcctcgctgcactcaccgaatgcgctgcctcaggagatggtaatatactggcgcttgctgtggacgcatctcgcgctaggtgcactgtgggggaaattacagatgccctgaagaaagtgttcggcgagcataaggcgaatgacagaatggtaagtggcgcgtatcggcaggaatttggagaatctaaggagattacatcagcaattaaacgcgtccataagttcatggaaagggagggaaggcgcccaagactcctggtggcaaaaatgggccaagacgggcacgatcgaggcgctaaagtgattgccaccgggtttgctgatcttggctttgatgttgacataggccctctgtttcaaaccccgcgcgaggttgctcagcaggctgtcgacgcagacgttcacgctgtcggcgtatccactctcgctgccggtcacaaaactctggtccccgagttgataaaggaactgaactccctcggaagaccagacatactggtgatgtgtgggggcgtcattccaccacaggattatgagtttctgtttgaagtgggtgtgtctaacgttttcggacccggaaccaggataccgaaggccgccgttcaagtattggacgacattgagaaatgtctggaaaaaaagcaacaaagcgtt

SEQ ID NO: 76 - DNA, 2250 bp, Artificial Sequence
  Codon optimized sequence that encodes an MCM polypeptide with the I671V mutation
atgctgagggcaaaaaatcaactgttcctgttgagcccccactatttgcgtcaagtgaaagaaagctccggctcccgcttaatccaacagcggttgcttcatcaacagcaacccttgcaccccgaatgggccgcccttgctaagaaacagctgaaggggaaaaacccagaagacctgatttggcacacccccgaagggattagtattaaacctctttacagcaagagggacacaatggatttacctgaagagcttcctggggtcaagccttttaccaggggaccatatccaacaatgtacacttttaggccatggacaattcgacaatatgctgggttcagcactgtggaggagtctaataagttctacaaagataacattaaagcaggacagcaaggactcagtgtcgcattcgatttagctacccatcgaggctacgactccgacaatccaagagttcgcggcgacgtaggcatggccggtgtcgcgatcgacactgtagaagataccaagatactgttcgacgggattccattggaaaaaatgtcagtcagcatgacaatgaacggcgccgtgattcccgtgcttgcaaactttattgttacgggtgaggaacagggagttcccaaagagaaactgacgggcacaattcagaatgatatcttgaaagagttcatggtaagaaatacatatatctttccaccagaaccctctatgaaaattatagcggacatttttgagtacaccgctaagcatatgcctaagtttaattctatctccatcagcgggtaccacatgcaggaggccggagccgacgccatcctcgaattggcctacacgctggcagacggattggaatattcccgaaccggactccaagctggcctcacaatagatgagttcgctccccgcctttcatttttttggggtatcggaatgaatttttacatggagatcgccaaaatgagggccggtagacggctgtgggctcatctgatcgaaaagatgttccagcctaagaatagcaagtctctccttttacgggcacactgtcagacgagtggatggagtttgacagagcaggatccctacaacaacatcgtgcgaaccgccattgaggccatggccgccgtgttcgggggaacccagagcttgcataccaactcctttgacgaagctctgggcctgcccacagtgaagagcgcccgcatagcacgcaacacacagattataatccaggaagagtcaggcattcctaaggtcgcagatccctggggtggttcttatatgatggaatgtctgacaaacgacgtctacgacgctgccctaaagttgatcaacgagatcgaggagatggggggcatggcaaaggcagtcgccgaggggatccctaagctgagaatcgaagagtgcgccgcacggaggcaggcccgaattgactcagggtctgaagtgattgtgggcgtaaacaaataccaattggagaaggaagacgctgtagaagtgcttgctatcgataataccagcgtgcgcaaccggcagatcgaaaagctgaaaaaaattaaatcttcgcgtgaccaggctctggcagagcgatgtctcgctgcgcttacagaatgcgccgccagcggagatggaaatatcctggcactggccgtcgacgccagtagggcccggtgcacggtgggagaaatcacagacgctctgaagaaggtttttggagagcacaaggcgaatgatagaatggtctcaggcgcttaccgtcaagagttcggtgagtccaaggagatcacctccgccattaaacgagtccacaagttcatggaacgagaaggccgtcgtccccgactgctggtcgccaagatggggcaggacggacacgaccgcggtgccaaggttatcgccacaggcttcgccgacctggggtttgatgtggatatcggacccctgttccagactccgagggaagttgctcaacaagcagtggatgctgacgttcatgccgttggtgtgtcgactctcgcagcggggcacaaaacgttggtgcccgaactgataaaggagctgaattcgttgggacggccggacattttggtaatgtgcggcggcgtgattccccctcaggattacgagtttctcttcgaggtgggtgtcagtaacgtgtttgggccgggaactagaattcccaaagcagctgtgcaggtgctggatgatatcgagaaatgccttgaaaaaaagcagcagagcgtg

SEQ ID NO: 77 - DNA, 2250 bp, Artificial Sequence
  Codon optimized sequence that encodes an MCM polypeptide with the I671V mutation
atgcttagggcaaagaaccagctgttccttctgtccccccactatcttagacaggtaaaggagagctcggggtcacggctgatccagcagaggctcctgcaccaacagcagcctctgcacccagaatgggccgccctggccaaaaagcaactgaagggcaaaaatccggaagacctgatttggcacacccccgagggtattagcataaaacccttgtacagcaaaagagataccatggacttaccagaagagttaccgggcgtgaaaccgttcacccggggaccctatcccacaatgtacaccttccgtccatggacaatccgccagtatgccggattcagcaccgtagaggagagcaacaagttttataaagacaatatcaaggccggccaacagggactctctgttgcgttcgaccttgccacccaccggggctacgactcggacaaccctagggtccgaggtgatgttggcatggctggtgtggccatcgacacggttgaagataccaagatcctgttcgatggaatacctctcgagaagatgtctgtttcaatgacgatgaacggcgcggttatcccggtgttggccaatttcattgtgaccggtgaggaacaaggggtccccaaggaaaagttaacaggcacaatccaaaatgatatcctcaaagaattcatggtgcgcaatacctacatctttccgccagaaccttcaatgaaaattatcgcagacatctttgaatacaccgccaagcacatgcctaagttcaattctatatcaattagtgggtatcacatgcaggaagccggtgcagacgctatattagagcttgcctacaccctcgccgatggcctggagtattctcgcacgggtttgcaggccggcctgacaattgacgagtttgcccctagactaagctttttctggggaatcgggatgaatttctacatggagatagcgaaaatgcgggctggaagacggctctgggcccacctcatcgaaaagatgttccagccaaaaaattcgaagtctcttttactgagagcacattgtcagactagtgggtggagtctgaccgagcaggatccgtacaacaacatcgtgagaactgccattgaagctatggccgcagtgtttgggggtacccagtcccttcacaccaattcctttgacgaggctctcggcctgccaactgtgaagtctgccaggatcgctcgaaatactcaaattatcattcaggaggagagcggaattcccaaggtggccgatccatggggaggttcgtacatgatggaatgtctgactaacgacgtctacgatgccgccctcaagctgattaacgagatagaagaaatgggaggtatggcaaaggcagttgctgaaggcatacctaagcttaggattgaagagtgcgcagcaagacggcaggctagaatagatagcggaagtgaagtgatcgttggggtgaacaaataccagctcgaaaaagaagatgccgttgaagtgctggcaattgacaataccagtgtccgaaataggcaaattgagaaacttaaaaagatcaagtcctctcgggatcaggccctggccgagcgatgtctggcggctctcacagagtgtgccgcatccggagacgggaacatccttgctctggctgttgatgccagcagggccagatgtactgtaggggagatcactgacgcccttaagaaggtcttcggggaacataaggctaatgacaggatggtctcaggagcctatcgacaagagtttggagagtctaaggagataaccagtgctatcaagagagttcacaaatttatggagagggaaggtcgccgccctaggcttctggtggccaaaatgggacaggatgggcacgatcggggcgctaaggtgattgctaccgggtttgccgatctgggttttgatgtcgatatcgggcccctcttccaaacaccaagggaggttgcccagcaagccgttgacgccgatgtgcatgccgtaggagtttcaactctggctgcaggacacaaaaccctcgtccccgagctcatcaaggagttgaattctttaggccggcctgacattctcgtgatgtgtgggggagtgattccgcctcaggactacgagttcctgtttgaagtgggtgtctccaatgtctttggacccggaacccggatacctaaggccgcagtgcaagtgctagacgacatagaaaagtgtttagaaaagaagcagcagtctgtc

SEQ ID NO: 78 - DNA, 2250 bp, Artificial Sequence
  Codon optimized sequence that encodes an MCM polypeptide with the I671V mutation
atgctaagagcaaaaaatcagctcttcctactgtccccacactacctgaggcaggttaaggagtcttcaggctctagactcattcaacagcgcctcctccatcaacaacagccccttcatcctgagtgggccgcattggcgaaaaagcagctcaaaggaaaaaatccagaggacctgatctggcacacaccagagggcatttcgattaagcccctatattctaaacgtgataccatggatctgccagaagagctccctggagttaagccatttacacgggggccctacccaacgatgtatactttccggccctggacaatcagacaatacgctggtttctcaactgtggaagagagcaataaattttacaaagacaacatcaaagctgggcagcaggggctgtccgtggcctttgatctggctacgcaccgaggatacgatagtgacaacccccgggtgcggggagatgtcggcatggccggggttgctatcgacaccgtggaggatacaaaaattctgttcgatggcatcccgctggagaagatgagtgtctctatgaccatgaacggagccgttatccctgtgctcgccaatttcatcgtcaccggagaagaacagggcgttcccaaagagaagctgaccggaactatccaaaatgatatcctgaaagaattcatggtccggaatacatatatctttcctcctgagccatccatgaagatcattgccgacatcttcgagtacacagcaaaacatatgccaaagtttaattcgattagcatctcggggtaccatatgcaggaagcaggtgccgatgctattcttgaacttgcctatacccttgcagatggcctggaatactctcgtaccggcctccaagctggcctgactatagacgagttcgcacccagactctcttttttctggggaataggaatgaacttttatatggagatcgccaaaatgcgtgcgggacgccgcctctgggcacatctgatcgagaaaatgttccaacccaaaaactccaaatctttgctgctgagagctcactgccaaacctccggctggagtctgactgaacaagacccctacaataacattgttcgtaccgctatcgaggcaatggcagcagtgtttgggggtacccaatcgctgcatacgaacagcttcgatgaagctttgggccttccaacagtaaagagtgcgcgtatagcgcgaaacacccaaattattatccaggaggagtccggcattccaaaagtcgctgatccctgggggggcagctatatgatggaatgcctgactaatgacgtttacgatgctgcgctgaaattgattaacgaaatcgaagaaatgggaggaatggcaaaggcagtcgctgagggcatcccaaagcttagaattgaagaatgtgcagctcggcgccaggctaggattgacagcggtagtgaagtcattgttggagtgaacaaatatcagctcgaaaaggaggatgcagtggaggtgctggcaatcgacaacacttcagtgaggaaccggcagatcgagaaactaaaaaagataaagagcagccgcgaccaggcattggccgaacgctgtctggccgcgctgaccgagtgtgctgccagtggtgatgggaacattttagcactggccgttgacgcttcaagggctcgatgcactgtgggcgagattacagatgcactaaaaaaagtcttcggcgaacacaaagcgaatgatcgtatggtcagcggggcctacaggcaggagtttggagaaagcaaggaaattacatctgccatcaagagggtgcataaattcatggagagggaagggaggaggcctagactgctggtcgccaagatgggccaagatggtcatgatcggggggcaaaagtgatcgccaccggctttgctgacttgggcttcgatgtggacattggacccctgtttcagacaccgcgcgaggttgcgcagcaagccgtggacgcagatgtgcacgctgtcggggtgagtacactggctgccggccacaagaccctggtgccagagttaattaaggaactcaatagcctcggacgtccagacattctcgtcatgtgcggtggggtaattcccccacaggactatgagtttcttttcgaggttggcgtatcaaatgtttttgggcctggtacacgaatacccaaagcggcagtccaggtgctggatgatatcgagaagtgccttgagaaaaaacagcagtctgtc

SEQ ID NO: 79 - DNA, 2250 bp, Artificial Sequence
  Codon optimized sequence that encodes an MCM polypeptide with the I671V mutation
atgcttagggcgaaaaaccagttgttcctcctatcaccccactatctcaggcaggttaaggagagctctggctcacgcctcatccaacagagactgttgcatcagcagcaaccactgcatcctgagtgggccgccctcgctaagaagcagcttaaaggaaagaatcctgaggacctgatttggcacacccctgaaggcatcagcatcaaaccgctgtattctaagagagacaccatggaccttcctgaggaactgcccggcgtgaaaccctttacacgcgggccctaccccactatgtacacattccgaccctggactatcagacagtacgcaggcttcagcaccgtggaggaaagcaataaattctacaaggacaatatcaaggcgggtcagcagggcctgtcagtggcatttgacctggcgacacacaggggatacgattcggataacccccgggttagaggtgacgttgggatggcgggggtggccatcgacacagtcgaagatacaaaaatcctgtttgacggtataccattagaaaaaatgagcgtgagtatgactatgaacggagctgtaatccccgtgctcgcaaacttcatcgtaacaggagaagaacagggagttccgaaggagaagctgacaggcaccatccaaaatgacatccttaaggagtttatggtgcggaacacgtacatattcccacccgagccttctatgaagattattgccgacattttcgaatatacggctaagcatatgcccaaatttaattcaatcagtatttccgggtaccatatgcaggaggccggagctgacgctattctggagctcgcatatacgctggccgatggattagagtactcccggacaggtctgcaggcaggactgacaatcgacgagttcgcacctcgtctgtcttttttttggggaatcggaatgaatttctacatggagatcgccaagatgcgcgccgggagacggctatgggcccacctcatagaaaaaatgttccagccaaagaatagcaagtccttgttactgagggcgcactgtcagacttcagggtggtctctcaccgaacaagacccctataacaacattgtacggaccgcaatcgaagcgatggcagccgtgtttggcggaacgcagtcccttcatacaaatagcttcgatgaagcgctcggcctccccaccgtgaaaagcgcccgtatagcccgtaatacacagatcatcatccaggaagaatcaggaattccaaaagtggctgatccctgggggggttcttacatgatggagtgcctgacaaacgacgtgtatgacgccgctctgaaacttataaatgagatcgaggaaatgggcgggatggccaaggcagtggccgagggtatccccaaactgaggatcgaagaatgtgctgcccgacggcaggctagaattgactctgggtctgaagtgatagtaggtgttaacaaataccagctggagaaggaggacgccgtggaggtcctcgcgattgacaacacctctgtgcgcaatcggcagatcgaaaagctgaaaaaaatcaagagtagtcgcgaccaggctttggccgagaggtgcctagccgcgttaactgagtgtgccgccagcggcgacggaaatattctagcactggccgtggacgcttcccgggccagatgcactgtcggtgaaattactgatgccctgaagaaggtgttcggcgagcataaggcaaacgacagaatggtgagcggagcctacagacaggagtttggggagtcgaaagaaatcacttcagcaatcaaaagagtacacaagttcatggagcgagagggtcgacgtcctcgactcctggttgcgaaaatgggccaagacggtcatgatcggggtgcaaaagtgattgccactgggttcgcagatctcgggttcgacgtggacattggaccattgttccagactcctagggaagtggctcagcaggccgtcgacgcagatgtacatgcagtcggcgtgtctacactggccgccggtcacaagacactggtgccagagctgattaaggagctgaatagcctgggacgaccggacattctcgtcatgtgcggcggtgtgatccccccccaggattacgaattcctgttcgaggtaggggtgagtaatgtattcggaccgggcaccaggattccgaaggccgcggtgcaggtactcgacgacatcgagaaatgtctggagaagaagcaacaatcagtt

SEQ ID NO: 80 - DNA, 2250 bp, Artificial Sequence
  Codon optimized sequence that encodes an MCM polypeptide with the I671V mutation
atgctcagagcgaaaaatcagctgttccttctgagcccacactatctacggcaggttaaagagtcatccggatccagacttatccagcagaggctgctccaccagcagcaaccattgcatcctgagtgggctgcgcttgcaaagaagcagctaaagggcaagaatcccgaagacctcatctggcatacccctgaagggatatctatcaaacccctctatagtaaaagagatacaatggatctccccgaagagttgcccggcgtcaagcctttcactagaggcccctatccgaccatgtacacctttaggccctggactattcgacagtacgccggattttcaaccgttgaggagagcaataagttttataaagataatatcaaggccggtcagcaggggctgtccgtggcctttgacctggccacacaccggggctacgacagtgataatccccgggtaagaggcgacgtgggtatggccggcgtagccattgacaccgtggaggacaccaagattctttttgatggaattcctctagagaagatgagcgtgagtatgaccatgaatggggccgtgattccagttctggcaaatttcattgtgaccggagaggaacagggggtgcctaaggaaaagctcacggggacgatccaaaatgacatactgaaggagttcatggtcaggaatacttacatctttcctcccgaaccttcaatgaagattattgcggatatctttgaatataccgctaaacatatgccaaaattcaactccatctcaatttcggggtaccacatgcaggaggcaggggcagatgccatactggagctcgcctacacactggctgacggcctagagtactctaggactggtttgcaagctgggctcaccattgacgaattcgcgccaaggttgagttttttttggggtatcggcatgaacttttacatggagattgccaagatgcgagccggtcgacgcctttgggcgcatctgatcgagaagatgtttcagccaaaaaacagcaagtccttattacttagagcccactgccagactagcggatggtccctgacagagcaggatccttataacaacattgttcgtactgcgattgaagccatggcagcggtcttcggaggaacccagtctttgcacacaaattctttcgacgaagccctgggcttacctaccgtgaaatctgcacggatcgcccgaaacactcaaatcatcatccaggaggagtctggcatccccaaggtggctgacccttggggagggtcatacatgatggagtgccttactaatgatgtgtacgacgccgccttaaagttgattaacgaaattgaggaaatggggggcatggcaaaagctgttgcagaggggattcccaagctgcggatcgaggagtgtgctgcccgccggcaagcacggattgattcagggtccgaagtaattgtgggcgtcaataagtatcagttagaaaaagaggatgcagtcgaagtcctggctattgacaatacaagcgtgagaaacaggcagatagagaagttgaagaagatcaaatctagcagagaccaggccctggcagaaagatgcctcgcggctctcaccgaatgcgctgcatctggcgacggcaacattctcgccctcgctgtggatgcgagtcgcgcccgttgcacggttggagaaattaccgacgcactgaagaaggtgttcggggagcataaagccaatgaccggatggtgtctggggcgtacagacaggagttcggcgagagcaaagaaatcacttcagccatcaaaagagttcacaagttcatggagagagagggaagacgaccgcggttactggtggctaagatgggacaggatgggcacgaccgaggagcaaaggtcatagcaaccggttttgccgatctggggttcgatgtggacatcggccctctattccagacaccgagagaagtggcacagcaggccgtggatgccgatgtgcacgcggtcggagtgtctacactggccgcgggccacaagactctggtaccagagctgataaaggagctcaattccctgggacggcccgacatcctggtcatgtgtgggggagtgataccccctcaggactacgaatttcttttcgaggtcggcgtttccaacgtctttggacctggtacaagaattccaaaagccgcagtgcaggtgttagatgatatagaaaagtgcttggagaagaaacagcagtccgtg

SEQ ID NO: 81 - DNA, 2250 bp, Artificial Sequence
  Codon optimized sequence that encodes an MCM polypeptide with the I671V mutation
atgctcagagcgaagaatcaactttttctgctttcacctcattacctgcggcaggtgaaggaaagctcaggaagtaggctgattcagcagcgcctcctgcatcagcagcaacccctgcacccagaatgggccgcactggctaagaagcaacttaaaggaaagaatcccgaggacctgatctggcacacccccgaaggaattagtatcaaaccactgtattccaagcgggacaccatggacttgccggaggagctgcctggagttaagccattcacgagaggcccttaccctactatgtatacgttcagaccttggaccatccgacagtacgctggcttttctaccgtggaagagtccaacaagttctacaaagacaacatcaaagccggccagcagggactgagcgttgcctttgacctagcgacacaccggggctacgattctgataatccgcgggtccgtggcgatgtcggaatggccggggtggctattgacacagttgaggacactaagattctttttgacggcatcccacttgaaaaaatgtccgtttctatgactatgaacggggccgtcataccagtcctggcaaatttcatcgtgaccggcgaggaacagggcgtgcctaaagagaagctcactggtacgatccaaaatgacatcctgaaggaatttatggttcggaacacctacatcttccctccggagccctcaatgaaaattatcgctgatatttttgaatacaccgcaaagcatatgcctaaatttaattctatctctattagcgggtatcacatgcaagaagctggcgcagatgcaatcctagagttggcctatactctggctgatggactggaatactctagaaccggtttacaggccggactgacaatcgatgagttcgcccctaggctcagctttttttggggaatcgggatgaatttttatatggagatcgctaagatgagggcaggtcgaaggctatgggcccatctcatcgagaagatgtttcagcctaagaattcaaaatcattgctccttcgtgcccattgtcagacgtctggctggagtcttacggaacaggatccctataataacatcgtgcgcaccgcgattgaagccatggctgcggttttcggcggaacccagtccctccacacaaactcatttgacgaggcgttgggacttcctacggtaaagtccgcccggatagccaggaatacccagatcattatacaggaagaatcagggataccgaaagttgcggacccttggggcggtagttacatgatggagtgtctcacaaacgacgtctatgatgcggccctcaaacttatcaacgaaatagaggaaatgggtggaatggcaaaagccgtggccgaaggaattcctaaattacggatcgaggagtgtgcagcacgacggcaagctcggattgatagtgggtccgaggtgatcgtgggggttaataagtatcagctggaaaaagaagacgccgtagaagtcctcgccatcgacaatacaagcgtgagaaacaggcagatcgagaaactaaaaaagattaaatcaagcagggaccaggcgctggcagaacgctgcctggccgccctcacagagtgtgccgcttcgggggacggcaatattctggccctggcggtcgatgccagccgagcaagatgtaccgtcggggagattacagacgcgttgaaaaaggtgttcggcgagcacaaagctaacgacagaatggtgagcggagcctacagacaagagtttggggagagcaaggagataacatccgcaataaagagggtgcataagtttatggaaagggaggggaggcggccccggctcctggtggccaaaatggggcaggacggtcatgacaggggggccaaagtgatcgcaacggggtttgccgacctggggttcgatgttgacataggtccactttttcagactcccagggaagtggcgcagcaggccgtcgacgcggacgttcacgccgtgggagtgtcaacactggccgctggtcataagactctggtgccagaactcataaaagagctgaactccctcggccgacctgatattctagtgatgtgcggtggcgtaatccccccccaggattatgaattcttgttcgaagtgggagtaagcaacgtgttcgggcctggcacaagaattcctaaagccgctgtccaagttttagatgatattgagaaatgcctagagaaaaagcaacagtccgtg

SEQ ID NO: 82 - DNA, 2250 bp, Artificial Sequence
  Codon optimized sequence that encodes an MCM polypeptide with the I671V mutation
atgttaagggctaaaaaccaattatttttgctgagtccgcattacctcagacaggtgaaagagtctagcggaagtcggcttatccagcaaaggttgctgcaccagcagcagcctctgcaccctgagtgggcagccctggccaaaaaacagcttaagggaaagaatccagaagacttaatctggcacacccccgaaggaatctccataaaaccgctctactccaaacgcgacaccatggatttgccagaggagctcccaggcgtgaagcctttcacaaggggcccttaccccacgatgtacacttttcggccatggacaattagacagtacgctggattttcaactgtggaagagagtaacaaattttataaagataatataaaggccggccaacaggggttgagtgtcgcattcgacttagcaacccaccgaggctatgatagtgacaatccgagagtgaggggtgacgtgggtatggccggtgttgctatcgacactgtcgaagacactaaaattctcttcgacggcattcccctcgagaaaatgtcagtgtctatgacgatgaacggcgctgtgataccagtgctcgccaacttcattgtaacaggcgaggagcagggtgtgcccaaagaaaaactgacaggaaccatacaaaatgatatccttaaggagtttatggtccgaaacacatatatcttcccaccggaaccaagcatgaaaattatcgccgatatattcgaatacacagcgaagcatatgcccaaatttaatagtatctcaatttcgggctatcatatgcaggaggccggggccgacgcaattctcgagctggcttatacactggccgacggtctggagtattctcggactggcctccaggcagggttgactatcgacgaattcgcaccacgcctgtccttcttttggggcatcggaatgaacttctacatggagattgcgaaaatgagagccggccgccgactgtgggcacatcttattgagaagatgtttcagcccaaaaatagcaaaagcctgctgcttcgggcccattgccagactagcggttggtccctcaccgagcaggatccctataataatatcgtgcggaccgccatcgaggccatggccgccgtatttggtggaactcaaagtcttcacacaaattcatttgatgaggcgcttggcctccctacagtgaaaagcgcacgcatagctcgcaatacccagattattatacaggaagaatcaggcattcctaaggtagctgacccctggggaggctcctacatgatggagtgtctcaccaatgacgtctacgacgctgctctgaaactcatcaatgaaattgaggagatgggaggcatggctaaggccgtcgccgaagggattcctaagctacgcattgaggagtgcgccgcccggcgccaggcacggattgactcgggatctgaggttattgtcggtgtgaacaaataccaactggagaaagaagacgctgtggaggttctcgctatcgataacacatcagtcagaaaccgacagatagaaaagctgaaaaaaatcaagtcatccagagaccaggctcttgccgaaaggtgtctggctgctctcacagaatgtgctgcttccggagatggcaatatactggccctggctgtagatgcgagccgggctagatgtaccgtcggggagattacagacgcgctcaagaaggtcttcggcgaacacaaagctaacgacaggatggtaagcggagcctaccgacaggagtttggtgaatcaaaggagattacctccgcgatcaaacgagtccacaaatttatggagagagagggccgcagacctaggctcctcgtggcaaaaatgggccaggatggacatgataggggagccaaagttatcgccactggctttgcagatcttggtttcgacgtggatattgggcctctgtttcagactccaagggaagtggcacagcaggcagtggacgctgatgttcacgcagtgggtgtgtcaacgctggccgccggccataagacccttgtccccgagctaatcaaggagctgaattctctggggaggccagacattctggttatgtgcggaggagtaataccacctcaggattatgagttcctctttgaggtcggcgtcagcaacgtttttggcccgggcacacgaatcccgaaggcagctgtgcaagtattggacgatatagagaagtgcctggagaagaagcagcagtccgtg

SEQ ID NO: 83 - DNA, 2250 bp, Artificial Sequence
  Codon optimized sequence that encodes an MCM polypeptide with the I671V mutation
atgctgagagccaagaatcaattgtttctgctgtcacctcactacctccggcaggtaaaagaaagctcaggctctcgccttattcagcagaggttgctccatcaacaacagccccttcatcctgaatgggctgcactggcaaagaagcaattgaaggggaaaaatcctgaggatttgatctggcacacccccgagggcattagcattaaacccctgtattcaaaacgcgacacgatggatctgccagaggaactgcctggagtaaagccatttactcgcggaccataccctaccatgtatacattccgaccctggacaatccggcaatacgccggttttagcaccgtggaggagagcaacaagttttataaggacaatatcaaggcaggccagcagggcttgagcgtggcctttgatttggccactcacagagggtacgattccgataacccaagggttaggggcgatgtggggatggcaggagtggcgattgatacagtggaggacactaagattctgttcgatgggatacctttggagaaaatgagcgtcagcatgacgatgaacggggcagtgatacctgttcttgccaacttcattgtaaccggggaggaacagggtgttcctaaggagaaactaaccggaacgatacagaatgacattcttaaggaattcatggttcgtaacacttacatctttccacctgagccctcaatgaaaattatagccgacattttcgagtatactgccaagcatatgcccaaattcaattcgattagcatcagcgggtatcacatgcaggaagcgggagctgatgcgatcctggagctcgcctatactcttgctgatgggctggagtactcacgaacagggttgcaggccgggcttactattgacgagttcgcgcctcgattgtcatttttctggggcattggcatgaacttctacatggagatagccaaaatgagagcgggacgcaggttgtgggcccacctgattgagaagatgtttcagcccaaaaatagcaagtctcttttgctacgggcgcactgccaaacaagtggatggtcactgactgagcaggacccatacaacaacatcgtccggactgccatcgaagccatggccgccgtttttggcggcacccagtcgttgcacaccaattcctttgacgaagccttgggccttccaactgtaaagagcgcacggatagctaggaatacgcagattattatccaggaggaatctgggatacccaaagtcgccgacccttggggaggaagttacatgatggagtgcttaacaaatgacgtttatgatgctgccctcaagctcatcaacgagatagaagaaatgggaggaatggcgaaggccgtcgccgaggggattccaaagttgcgtattgaggagtgtgccgccagaagacaggcccggattgactcaggctccgaggtcatcgtcggggtgaataagtaccagctggaaaaagaagatgcagtggaagtcctcgccatagataatacctctgtacggaataggcagattgagaaacttaagaaaattaagagcagccgggaccaagcccttgccgaaaggtgtctcgccgctttgacagagtgcgccgcgagcggagatggcaatattctggctctggccgtggatgccagccgcgcgcgctgcactgttggggaaattacggatgccttaaaaaaagttttcggggaacacaaggctaacgacagaatggtctctggggcgtaccgccaggaatttggcgagagcaaagaaattaccagcgctattaagagggtgcataagttcatggagcgggagggtagacgccctagactccttgtcgccaaaatgggacaggacggacacgaccgcggagccaaggtgattgcaacgggctttgctgacctgggctttgacgtcgatatcggccctctgttccagactccacgcgaagtcgcccagcaggccgtcgacgctgatgttcatgccgtaggagtgtccacactcgcggcggggcacaagactttagtacccgagctgattaaggagctgaacagcctggggagaccagacatcctcgtcatgtgcggcggggttattccacctcaggactacgagtttttattcgaagtgggggtatctaacgttttcggacctggtactcgtattcccaaggccgctgttcaggtcctggacgacattgagaagtgcctggagaagaagcaacagtctgtt

SEQ ID NO: 84 - DNA, 2250 bp, Artificial Sequence
  Codon optimized sequence that encodes an MCM polypeptide with the I671V mutation
atgctcagagcgaaaaaccagcttttcctcctttctccgcactatctgcgacaggtcaaagaaagttctgggtctcgtctgattcagcaacgcctactgcaccagcagcagccactgcaccccgagtgggcagcgcttgccaagaagcagcttaagggaaaaaacccagaggatctgatctggcacacccccgagggaattagcataaagcctctgtattccaagcgggatacaatggacctccctgaggagcttcccggcgtgaagccattcacccgtgggccctatccgaccatgtacactttcagaccctggaccattcgacagtatgctgggttcagtaccgtagaagagagtaacaagttttataaggacaatatcaaggccggccagcagggcctatccgttgcctttgatctggcgacgcaccggggctatgacagcgacaacccaagggtccgcggggacgtgggaatggccggtgtcgccatcgatacagtcgaagacaccaaaattctgtttgatggcattcctctggaaaaaatgtctgtgagtatgactatgaacggggccgtgatccccgttcttgctaactttattgtaacgggggaggagcagggcgtaccaaaagaaaagctcacagggactattcagaacgacatccttaaagagtttatggtaagaaatacttatatctttcctcctgagccttcgatgaagataatcgccgacatttttgagtatactgcaaagcacatgcctaagtttaattccatcagtatcagcggttatcatatgcaggaggctggagctgacgccattctagaacttgcctacaccctggccgatgggttggagtacagtaggacaggtttgcaggctggcttaacaatcgatgaatttgcccctaggctgtccttcttctggggcataggcatgaacttttacatggagatagctaaaatgcgcgctggcagaaggctgtgggcccatctgattgagaagatgtttcaaccaaagaacagtaagagcctactcttgcgggcccactgccagacttcgggctggagcctgacagagcaggacccctacaacaacatcgtccgcactgccatcgaagctatggccgctgtattcggcggcacgcagtcccttcacaccaactcgttcgacgaggctctcgggctgcctactgtcaagtcagccaggatagcaaggaacacacagatcatcattcaagaggaaagcggcattccaaaggttgctgacccgtggggaggctcctacatgatggaatgcctgaccaacgacgtttatgatgctgcactcaagttgatcaacgaaatcgaagagatgggcggaatggctaaagctgtggccgagggcattccgaagcttagaatagaggaatgcgccgccagacggcaggcccgtatcgacagtggctctgaagtaattgtcggtgtcaataaataccagctggaaaaggaagacgcagttgaagtcctggcaatagacaatacaagcgttcggaacagacagattgagaaactaaaaaagataaagtcttctcgggatcaggccctagcggaacgttgcctggctgcccttaccgagtgcgcagcctctggcgacgggaacatcttagccttggcagtggacgcgtcacgcgcaagatgtaccgtgggcgaaattacagacgccttgaaaaaagtttttggtgaacacaaggcaaatgaccgtatggtgagcggggcctaccggcaagagttcggggagagcaaagagataacgagcgcaattaaaagggtgcataagtttatggagagggaaggtcgccggccgagactgctggtagccaaaatggggcaggacggccatgatcgaggcgctaaagtgattgctaccggcttcgctgatctggggtttgacgttgacattgggccattgttccagactcctagagaggtggcccaacaggctgttgatgcggacgtgcacgctgtaggcgtgtcaacattagctgctggacacaagactctcgtgcccgaactgatcaaggagcttaattcattgggaaggcccgatatccttgtcatgtgcggaggagtgattcccccccaagattacgaatttctcttcgaggtaggagtcagtaacgttttcggaccagggacgagaatccccaaggctgccgtgcaggtgttggatgatattgagaagtgcctcgaaaagaagcagcagagcgta

SEQ ID NO: 85 - DNA, 2250 bp, Artificial Sequence
  Codon optimized sequence that encodes an MCM polypeptide with the I671V mutation
atgctccgcgccaagaatcagctgttcttgctcagtccacattatctgaggcaggtcaaggaatcctccgggagcagactgatccagcagagactgcttcaccagcaacaacctctgcacccagagtgggcggcgctcgctaagaagcagctgaaaggtaagaaccccgaagatctgatctggcacaccccggaggggatctccattaagcctctttattccaaacgggacaccatggatttgcctgaagaactgcccggtgtcaagccattcactcgggggccctaccctaccatgtacacattccggccttggactatccgacagtacgcagggttttccaccgttgaggaaagcaataaattctataaggataacatcaaagccggtcagcaaggcctctccgtcgcttttgatctcgccacacatcgcgggtatgattcagataatccacgagtcaggggggatgtcgggatggcaggagtcgctatagatacagtcgaagataccaagatattgtttgacggtattcctcttgaaaagatgtcagtttctatgacgatgaatggtgccgtcataccagtactggcaaatttcattgtaactggggaggaacagggagtgcccaaggaaaagcttactggcacaattcagaatgacatccttaaagaatttatggtgcggaacacctatatctttccacctgaacccagtatgaaaattatcgctgatatctttgaatatactgccaaacacatgccaaagttcaactctatatctatcagcggttatcatatgcaggaagccggagccgatgcgattctggaactggcctacaccttggctgatggcctggaatactctcgcactggtctgcaagctggcttgacaattgacgagttcgccccacggttgtcctttttttggggcattggaatgaatttttacatggaaatcgcgaaaatgcgcgctggcaggcggctctgggcccaccttattgagaagatgttccagccaaaaaattcgaagtccctgctgttgcgagcccactgccaaacaagtggatggagtctcactgagcaagacccttacaataacatcgtccggacagctatcgaggcgatggctgccgtgttcggagggacccagtctcttcatacaaactcttttgacgaggccctgggactccccactgttaagagtgctcgcattgctcggaacactcaaatcatcatccaagaggaatccggtatccccaaagtcgccgatccctggggaggctcatatatgatggaatgtctgaccaacgacgtgtacgatgcggctctcaagctgattaatgagattgaagagatggggggaatggctaaggccgtggccgagggaattccgaagctgcgcatcgaggagtgtgcggccaggagacaggcccggatcgacagcggaagtgaagtgatagtgggcgtcaataagtatcagctagagaaagaagacgccgtggaggttctagctatcgacaacacgtccgtgcgtaacaggcagattgagaaactcaagaaaattaagagctcccgcgatcaggccttggctgagagatgcttagccgccctgactgaatgtgctgcctccggggacggtaatatcctcgccctcgctgttgatgcttcaagggcgcgttgcactgttggcgagattaccgacgctctaaaaaaggtgttcggggagcataaagctaacgaccggatggtgtccggtgcatacagacaagagttcggtgagagcaaggagattacttccgcaatcaagcgggtgcataagttcatggaaagggaaggtcggagaccaaggctccttgtcgccaaaatggggcaggatggacacgacaggggagccaaggtgattgctacaggtttcgccgacttgggtttcgatgtagatattggacccctttttcaaacacccagagaggtggctcagcaggccgtcgacgccgatgtgcacgcagtgggggtgtccaccctcgccgcagggcacaagaccctcgtacccgaattgattaaggagcttaactccctgggcagacctgacattttggttatgtgtggtggtgtgataccgccacaggattacgaattcctgtttgaggtgggagtgagcaacgtattcggccccggcaccaggatcccgaaggctgccgtacaagtgttggatgacatcgagaagtgcctcgagaagaaacagcagtctgtc

SEQ ID NO: 86 - DNA, 2250 bp, Artificial Sequence
  Codon optimized sequence that encodes an MCM polypeptide with the I671V mutation
atgcttagggcaaaaaaccagttattcttgctgagcccgcactatttgcgtcaagtcaaggagtctagcgggtccagactgattcagcagcgactgctgcatcagcagcaacctctccaccccgagtgggccgctttagccaaaaaacagttaaaaggcaaaaatcccgaagacctgatctggcacactccagagggcattagcatcaaacccctgtattctaaacgcgataccatggaccttccagaggaactgccaggcgtgaagccgttcacacgtggaccttatcccactatgtacaccttccgcccatggactattcggcagtacgccggtttttctacggttgaagaaagcaataagttctataaagataatatcaaagccggacagcagggactgtctgttgcattcgacctggccactcacagagggtatgactcagataatcccagagtcagaggtgacgttggcatggccggggtggctattgatacagtcgaagacacaaaaatactgtttgacggaatccccctcgaaaaaatgagcgtctcaatgacgatgaacggtgccgtgatacccgtccttgcgaatttcattgtcacaggagaagagcagggggtcccaaaagaaaaactaacaggtacaattcagaatgacatcctgaaggaattcatggttcgcaacacttacatctttccccctgaaccctcgatgaagatcatcgccgacattttcgaatataccgcaaaacacatgcctaagttcaactccatctccatcagcgggtaccacatgcaggaagccggggctgacgcgatcctggagctggcatacactctcgccgatggcttagagtattccagaaccggcttgcaggcaggcctgacaatagacgagtttgcgccacggctgtctttcttctggggaatcggcatgaacttttacatggagatagcaaagatgagagcagggcggcgcttgtgggctcatctgatcgagaaaatgttccagccgaagaacagcaagtccctgctgctgcgggcccactgtcaaacctctggttggagcctgacagagcaggatccttacaataatatagtgcgaacagcgattgaggcaatggctgctgtgttcggcggaacacagagtctgcatacaaactcttttgacgaggcccttggcctgccaacagtgaaaagcgctagaatcgcccggaatactcagatcataatccaggaagagagtggaatccccaaagtggcagatccttggggtgggagttatatgatggaatgtctgaccaatgatgtctacgatgccgctctcaagctgattaatgaaatcgaggagatgggtgggatggccaaggctgtcgccgagggtatccccaaactcaggattgaggagtgcgctgcccggagacaggcgcgaatcgattcgggctctgaggtgatcgtgggcgtgaacaagtaccagctagagaaggaggacgctgtggaagtcctggccattgataataccagtgtgcggaacaggcagatcgaaaaattaaaaaaaattaaaagtagtcgcgaccaagcactggcagagcgctgcttggcggccctgacggagtgcgcagcctctggagatggcaatatcctggcactggccgtcgacgcctcaagagctcgatgcaccgtaggcgagatcaccgacgccctgaagaaggtcttcggagaacataaagccaatgaccggatggtgagcggcgcctataggcaggagtttggggagagtaaagagatcacatctgcaataaagcgtgtgcataagtttatggaaagggagggaaggcgcccacgactccttgttgctaagatgggtcaagacggccatgaccgcggcgccaaagtcatcgcaaccgggttcgctgacttggggtttgacgtcgatatcggacccctgtttcagacgccacgggaagtagctcagcaagccgtggacgcggatgtgcacgccgtaggcgtgtctaccttggcagcaggccataaaaccctagtgcccgagctcataaaagagctgaacagcctgggacggcctgacatcctagtgatgtgcgggggcgtcatcccacctcaggattatgagttcctcttcgaggtgggagtttccaatgtgtttggacccggcacacgaatccccaaagcagccgtgcaggtgttggatgacatcgagaaatgcttagaaaagaaacaacagtccgtc

SEQ ID NO: 87 - DNA, 2250 bp, Artificial Sequence
  Codon optimized sequence that encodes an MCM polypeptide with the I671V mutation
atgctgcgcgcaaaaaaccaactgttcctcctgagcccacactatttgcgacaggtcaaagagtcctctggatcaaggttaatccagcaacggctcctgcatcagcagcagccactccaccccgagtgggccgcccttgcaaagaagcagttaaaaggcaaaaatcccgaagatctgatctggcacacaccagagggaatcagcatcaagccgctttacagtaaaagggacactatggatcttcctgaggaactcccaggcgtgaaacccttcacgaggggcccttatcccactatgtatacctttagaccctggaccattaggcaatacgccggattctcgaccgtggaagagtctaataagttttacaaggacaatattaaggcagggcagcaggggttgagtgtcgcctttgatctcgcaacacatagggggtacgacagtgacaatccaagggtccgaggtgacgtggggatggcgggcgtggccatcgacactgtggaggatactaagattctgttcgatggaatccccctggagaaaatgtcagtctccatgacaatgaatggtgctgtaattcctgttctggctaactttattgtgaccggggaagagcagggagttcccaaggaaaagctaactggcactattcaaaatgatatccttaaagaattcatggtccgaaatacctatatatttccacctgagccatctatgaaaataattgcagatatctttgagtatactgctaagcatatgccaaagttcaacagtattagcattagtgggtaccacatgcaggaagctggggctgatgcaattctggaacttgcgtataccttggccgatggactcgaatacagccggaccggcctgcaggccggactgacaatagatgagttcgctccacgcctttctttcttttggggcattggaatgaacttctacatggaaattgcaaagatgcgggctgggagaaggctatgggctcacctcatcgaaaagatgtttcaacccaaaaatagcaagtctctcctcctgcgggctcactgccagaccagcgggtggtctctcaccgagcaagacccttacaataacatcgtgagaactgccattgaggcgatggctgctgtgtttggtggtacccaatcacttcacacgaactcttttgacgaggcccttgggctgccaaccgtgaagagcgctcggattgctcgcaacactcagattataattcaggaggagtcaggcatccccaaggtggcggacccttggggaggaagctacatgatggagtgcctgaccaacgacgtgtacgatgcagctctgaagctgatcaacgaaatcgaagaaatggggggtatggccaaggccgtggccgaagggattcctaaactgagaattgaagaatgtgctgctcgccggcaggccagaattgatagcgggtcagaggtgatcgtgggggtgaacaagtatcaattggagaaggaagacgccgtcgaggtgttagcaatagataatacttctgtcagaaatcgtcagatcgaaaagctcaaaaagatcaaatcctctcgggatcaggctcttgctgagaggtgcctcgctgccctgactgaatgcgccgcttcgggcgacggtaatatcctggcattagctgtggacgcctcacgggcgcgttgcaccgtaggtgagattacagacgcccttaagaaggttttcggggagcacaaggcaaacgaccgaatggtgagcggggcttacaggcaggagttcggagagtcaaaagagattacatctgccatcaagcgcgtccataaattcatggagcgcgagggacgcagacccagactgctcgtcgctaaaatgggacaggatggccacgaccggggcgccaaagtcatcgccaccggcttcgccgacctgggcttcgacgtggatataggtccgctattccaaactcccagagaagttgcccagcaggcagtggatgccgacgtgcacgctgtcggggtctccaccctcgctgcaggccataaaaccttggttccggagttaattaaagaacttaacagcctaggacgccctgatatcttggtgatgtgtgggggtgtgatcccaccccaggactatgaattcctgttcgaggtcggagtgtccaatgtgttcgggcccgggacccgaatacctaaggccgcagtgcaagtgttggatgatattgaaaagtgtctagaaaaaaaacagcagtctgtt

SEQ ID NO: 88 - DNA, 2250 bp, Artificial Sequence
  Codon optimized sequence that encodes an MCM polypeptide with the I671V mutation
atgctgcgcgcaaagaaccagctgtttttactgtcacctcattacctgcgccaggtcaaagaatctagtggatccagactgatacaacagcgtctgctgcaccagcaacagcctttacaccctgagtgggctgccctcgctaaaaagcagctgaagggaaagaatccagaggatcttatttggcacacacctgagggcatatcaatcaagcctctttatagcaagagggatacgatggacttgcctgaagaactccccggcgttaagcccttcaccagggggccatatccaactatgtatacgttcagaccctggactattcggcagtacgccggattctccaccgtggaagaatcaaataagttctacaaagataacatcaaagcaggccagcagggcctgagtgtcgctttcgatctcgctacacatcgcggctacgattcagacaaccccagagtgaggggagatgtgggcatggcaggggttgctattgatacagtggaggatactaagatcctgttcgacggcatccctcttgaaaagatgtcagtgagcatgacaatgaacggcgccgtgataccagtcctggcaaattttatcgtgacaggggaagagcagggtgtgcctaaggagaaactgaccggtactatccagaacgacatccttaaagaatttatggtgcggaatacctatatttttcccccagaaccaagtatgaaaattatagcagacatcttcgagtacacggcgaaacatatgcccaagttcaattcaatcagcatctctggttaccacatgcaagaagctggggccgacgctatcctggaactcgcttacactctggcagacggactagagtattcacgcacaggcctgcaagcaggattgaccatagatgagttcgcccccaggctgtctttcttctggggtatcgggatgaacttttatatggagatcgcaaagatgcgcgccggacgtagactatgggcgcacctcattgagaaaatgttccagccaaagaactccaagagcctgcttcttagggctcactgccagactagtggctggagcctgaccgaacaggacccttataacaacatcgtccgcactgccatcgaagctatggctgcagtctttgggggtacacagtccctccacaccaattctttcgacgaagccctgggcttgccgaccgtcaagagcgctcgtatcgcgagaaatacccagattattatccaagaggaatccggcatccccaaggtggctgacccttggggcggaagctacatgatggagtgtcttactaatgacgtatacgatgctgccctgaagctcattaatgaaatagaagaaatgggaggtatggcaaaagctgtggcagagggcataccgaagctgagaatcgaggagtgtgccgcacggcgtcaggccaggattgatagcggttccgaagtgatcgtcggagtgaacaaataccaactcgaaaaagaggacgcagtcgaggttttggccatcgacaacacttccgttcgtaaccggcagattgagaagcttaagaagatcaaatctagccgcgaccaggctctcgccgaacgttgcctggcggccctcaccgagtgcgcagcatccggagatggtaatatcttagcactggctgtggacgcctcccgcgcccggtgtactgtaggggagatcacggatgccttaaagaaagtctttggcgaacataaggcaaacgacaggatggtaagcggagcttaccggcaggaattcggggaatcaaaagaaatcaccagtgctatcaaacgggtgcataagttcatggagcgggaaggacgccgcccacgactactcgtggccaagatggggcaggacggacatgaccgaggagccaaagtaattgctaccggtttcgctgacctggggttcgatgtggatatcgggccactctttcagactcctcgcgaggtcgctcagcaagctgttgacgcggatgtccacgctgtcggtgtctccactctagcagccggccacaaaacgttggtgcccgaactaattaaagaactgaattcactgggaagacccgacatattggtcatgtgcggaggggtgattccaccccaggactatgagttcctgtttgaagtgggcgtttcaaacgtattcggaccagggacccggattcccaaggctgccgtgcaggtgctcgacgatatagagaaatgcctggagaagaagcagcagagtgtg

SEQ ID NO: 89 - DNA, 2250 bp, Artificial Sequence
  Codon optimized sequence that encodes an MCM polypeptide with the I671V mutation
atgctgcgggctaagaaccagttgtttctgctgtcaccacattatctgcgccaggttaaggaatctagcggctcaagactgattcagcagcgccttctgcaccagcaacaacccctgcatccagagtgggccgcgctcgcaaaaaaacagttaaaggggaagaacccagaggatctcatctggcatacgcccgagggtatttcgattaagcccttgtattctaagagagataccatggacttgccagaagagcttcctggagttaaaccatttacacgagggccctaccccactatgtatacgttcaggccctggactattagacagtacgcaggtttcagtactgtggaagagtcaaataagttctataaagataatatcaaagccggtcaacaggggttgtcagtggctttcgatctggctacccatcggggttacgacagtgataaccctagggtaagaggggatgtcggaatggccggcgtggccatagacactgtggaggatacaaaaatcctgttcgacgggattcctctcgagaaaatgagtgttagtatgacgatgaatggcgccgtcataccagtcctcgccaattttatagtgactggggaagaacagggggtgccaaaagagaagttgaccggaaccatccagaacgatatattaaaagagttcatggttcgaaatacttacatttttcctccggagccttcaatgaaaattatcgccgatatctttgagtacacagcaaaacacatgccaaaattcaacagcatctcaataagcgggtatcatatgcaagaggccggtgctgatgcaattctcgagctcgcctacactctggctgatggcctcgagtattcccgcaccgggctccaagccggcctgacgattgatgaattcgctccaaggctgtcttttttctggggcatcggaatgaatttctacatggagattgctaagatgagagcagggaggcgcctttgggcacacctaatagagaagatgttccagcccaaaaactccaaatctttgctgctgcgcgcacattgtcagactagtggttggtccctgactgagcaagatccctacaacaacatagtgcgaaccgccattgaagccatggcggccgtctttgggggcacgcagagcctgcacaccaattcctttgatgaagctttgggcctgccaacagtcaagtctgcacggattgcacggaacacccagatcatcatacaggaggagagcgggataccaaaagttgccgatccctggggaggatcctacatgatggagtgtttaacaaacgacgtgtacgacgcagccctgaaattgataaacgagattgaggagatgggaggcatggccaaagccgtcgctgagggcattccaaaacttcgcatcgaagaatgtgctgcccgtcggcaggcccgaatcgactctggttctgaggtgatcgttggagtgaacaaatatcagctcgagaaggaagatgccgtggaggtactggccatagacaacacatccgtccgaaaccgacagatcgagaagttaaagaagattaagagttcccgagaccaggcgctggccgaacggtgtctagctgccttgacagagtgtgctgcgtccggggacggtaatatactggccttagcagttgacgcttcgagagccaggtgtacagtgggggagatcactgatgccttaaaaaaggtcttcggtgagcataaggctaacgatcggatggtatcgggggcctacagacaagagttcggcgagtcgaaggagattactagcgcaattaagagggtccacaaattcatggagcgagagggtaggaggcctcggctcttagtcgcaaaaatggggcaagatggccacgatcgaggagccaaggtgattgctaccggatttgctgatctaggcttcgatgttgacattgggccgttgttccaaacgccccgggaggtggcacagcaagccgttgacgcagacgtgcatgccgtcggtgtgagtacccttgctgcaggacataaaactcttgttcctgagcttataaaagagttgaattctctgggtcgccctgacatcctggtcatgtgcggaggtgtcattccgccccaagattacgaattcttgtttgaggtcggggtaagtaatgtgttcggcccaggtacgcggattcctaaagctgctgttcaggttctggatgatatcgagaaatgcctcgagaaaaaacagcagagtgtc

SEQ ID NO: 90 - DNA, 2250 bp, Artificial Sequence
  Codon optimized sequence that encodes an MCM polypeptide with the I671V mutation
atgctgcgggcaaaaaatcaattatttcttctgtccccccactaccttagacaagtcaaagaatcctcaggtagccgtcttattcagcagagattgttacaccaacagcagcccctgcaccctgagtgggcagcacttgccaagaagcagctcaaggggaaaaatccagaggatctgatttggcatacacctgaaggaatctccatcaagcccctatattctaaacgggacactatggacctgcctgaggaactcccaggggtgaaaccgtttaccaggggaccctacccaaccatgtataccttccggccctggacaatccgtcagtacgccggtttttctaccgtcgaggaatccaataagttttataaagataacatcaaggctggccagcaaggccttagcgtggcctttgatctggctacccatcgggggtacgactccgataacccccgtgtgagaggagacgtaggcatggcaggggtggctatcgacaccgtcgaggacacgaagatactgtttgacggaattcccctggaaaagatgtcagtgtccatgaccatgaatggcgcggtgatcccagttctggccaacttcatcgttacaggagaagaacagggcgtgcccaaggagaagctgaccgggactattcaaaatgatattctcaaagaatttatggtgcgcaatacctatatctttccccccgaaccaagtatgaaaattatagccgatatcttcgaatataccgctaagcacatgcctaagttcaacagcattagcatcagtggttatcatatgcaggaagcaggcgcagacgccatcttagaactggcatacacactggccgacggactggagtattcccggactggcctccaggctgggctgactatcgatgagttcgccccccgactctcttttttctggggaattggaatgaatttctatatggagatcgccaagatgcgggctggccgaaggctgtgggcccatctgatcgaaaaaatgttccagcccaagaactcaaagtcgctgctccttcgggcccactgccaaacctccggttggtccctgaccgagcaggatccctacaacaatatcgtgcgaactgccattgaggctatggccgctgtgtttggtggcacccagtccctacatacaaacagctttgacgaagctctgggactcccaaccgtgaaatctgccaggatcgcgagaaacactcagattattatccaggaggaaagtggcatccccaaggtggccgacccatggggcggctcatatatgatggaatgcctgactaatgacgtgtatgacgctgccctgaaactgatcaacgagatcgaggagatgggaggcatggccaaagctgttgctgagggcataccaaagctgcgtatcgaagagtgcgctgcacggagacaggcgagaattgactccgggtccgaggtaattgtgggagttaataagtaccagctggagaaggaagatgccgtcgaggttctggcaattgacaatacatccgtgagaaaccgacagattgagaagctgaaaaaaattaagtcttccagagaccaggccctggcggagcgctgtctggctgcactcactgagtgcgccgcgtcgggggatggcaacatcctggctctcgccgtggacgcatcgcgcgcccgctgcaccgtcggcgaaatcacagatgccttgaagaaggtgttcggcgagcacaaagccaatgacagaatggtgtctggggcctacaggcaagagtttggagaatccaaggaaataacttcggcaataaagagggttcataaattcatggagcgggagggtaggcgtcccagattactggtggccaagatgggacaggacgggcacgataggggagcaaaggtgatcgctactgggttcgccgacttaggatttgacgtggacataggccccttattccagacgccaagagaagtcgcacagcaggcggtagacgcagacgtgcacgcagtcggggtgtccacactggccgcggggcacaagaccctggttccggagctcattaaggaactgaattctttgggcagacctgacattcttgtgatgtgtggaggagtcatacctcctcaggactacgaattccttttcgaggtgggggtgtctaatgtattcgggcctggcacccgaattcccaaggccgcggtgcaggtactcgacgacatcgaaaaatgtctggagaaaaaacagcagtccgtg

SEQ ID NO: 91 - DNA, 2250 bp, Artificial Sequence
  Codon optimized sequence that encodes an MCM polypeptide with the I671V mutation
atgcttcgtgcaaaaaaccaactctttctgttatccccccactacctcaggcaggtgaaagagtcaagtgggtcccggctaattcagcagcgtctgctgcatcagcaacagcctcttcaccctgagtgggcagctctcgccaagaagcagctcaagggcaagaatccagaggatctgatctggcacactcccgagggcattagcatcaaacccttgtattcaaagcgcgacaccatggacttacccgaggagctgcctggcgtgaaacccttcacgcggggaccatatccaactatgtatactttcaggccttggacaattcgtcagtacgctggtttttccacagtagaggagagcaacaagttctacaaagataacataaaggccggacagcaggggctgtcggtcgctttcgatctggctacccaccggggctatgattcggacaacccaagggttagaggtgatgtgggaatggccggtgtcgcgatcgataccgttgaagacaccaaaattctattcgacggaattcccctggagaaaatgtctgtttctatgactatgaatggcgcagtcattcccgtccttgccaattttatcgtcaccggagaagagcaaggggtcccaaaagaaaaactgactggcaccattcagaacgatattctgaaggagtttatggttaggaatacctacatctttcctccagaaccaagcatgaagataatcgccgacatctttgagtacacagctaaacacatgccgaaattcaacagcatcagcatcagcggatatcacatgcaagaggcaggggctgatgctatcctcgaactggcgtacactctcgctgatgggctggagtacagcagaacagggctgcaggcagggctgactatcgacgaattcgctccccgcctgagcttcttctggggcattgggatgaacttttatatggagattgctaaaatgcgggcgggaagacggctatgggctcatctgatcgagaaaatgtttcagcctaagaactccaagtcgctcctgctgagggcccattgccagaccagcggttggagcctgaccgagcaggacccgtacaacaacatcgtgagaacagccatcgaggccatggctgcggtctttgggggtacccagagtctccatacgaattcttttgacgaggccctcggacttccgacagtcaagagcgcccggatcgctagaaatactcaaatcatcatacaggaggaatctggcattcccaaagtcgcagacccgtgggggggcagttacatgatggagtgtctgacgaacgacgtgtatgatgccgcgttaaagctgatcaatgagatcgaggagatgggggggatggccaaggcagtagcggaaggcattcccaaactccgaattgaggagtgcgccgcgcgacgccaggcccgaatcgactctggaagcgaggtgatcgtgggagtgaacaagtatcagctggagaaggaggacgctgtggaagttctcgcaattgacaacacttcggtgaggaatcgacagatcgagaaactgaagaagatcaaatcaagtcgcgaccaagcgctggccgaaaggtgtctggcggccttgactgaatgcgccgccagcggcgacggcaatattcttgcgctggcggttgatgcttcccgggctagatgcaccgtaggcgagattactgacgctcttaagaaggtatttggtgaacataaagcgaatgatcgcatggtgtctggcgcataccgccaggaattcggagagtccaaagagataacttcagctattaaaagggtccacaagttcatggaacgcgagggccgtcgcccccgcctgctggttgcgaagatgggccaggacgggcacgacagaggcgctaaagtcattgcaaccggtttcgccgatctgggctttgacgtggacatcgggcctctgttccaaacgcccagggaggtggctcagcaggccgtggatgctgatgtgcatgccgttggtgtgagtacattggcagctggccacaaaacgctcgtgcctgaactgattaaggagctgaattcgctggggcggcctgatattttggtgatgtgcggtggagtaatccctcctcaggactatgagttcctgtttgaggtcggggtttcaaacgtgtttgggccgggaaccaggatccccaaagctgcagtccaagtcctggacgatatcgagaaatgcctggaaaagaaacagcaatccgtg

SEQ ID NO: 92 - DNA, 2250 bp, Artificial Sequence
  Codon optimized sequence that encodes an MCM polypeptide with the I671V mutation
atgctccgggcaaaaaaccagctctttctgctgagccctcattacctgaggcaagtgaaggagtcaagtgggagtcggctgatacagcagaggttactgcaccaacaacaaccactgcatcctgaatgggcagcactggcaaagaagcagctcaagggaaaaaaccccgaagacttaatttggcacacacctgaaggaatcagcattaagccgttgtattcgaagagggatacaatggatctcccggaggaactgcccggagttaagccattcacccggggaccataccctacaatgtatactttccgcccttggaccatccgtcaatatgccggcttttccactgtggaagagagcaataaattctacaaggataatatcaaggccggacagcaaggcctatctgtggcgttcgacctggcaacccaccgtgggtacgatagtgacaacccaagggtccgtggggacgtggggatggctggggtggctattgatacagtggaagacacaaaaatcctctttgacggaatacctctggaaaagatgagtgtctccatgacaatgaacggcgccgtgatccccgtgctggccaacttcatcgtgaccggagaggagcaaggggtgcctaaggaaaagctcacagggaccatccagaatgatatcctcaaagaattcatggtgaggaatacatacatctttccgcccgagccaagcatgaagattatcgctgacatcttcgagtatacggctaagcacatgcctaaatttaacagtattagtatttctggctatcacatgcaggaagcaggggctgatgctatcctggagctggcgtacacactcgccgatgggttggaatacagtaggaccggactacaggctgggttaaccattgatgagttcgcacctcgccttagcttcttctggggtataggcatgaatttttacatggagatcgcaaagatgagggcgggccgaaggctctgggcgcatctcattgagaaaatgtttcagccaaaaaactctaagagtctactgctgcgggcccactgtcagacaagcggctggtcgttgaccgagcaggacccctacaacaacatcgttcggacagcgatcgaagccatggcagcagtcttcggagggacccagtccttgcacaccaattcatttgatgaggctctcggtctgccaactgttaaaagcgctagaatcgcccggaatacacagattattatccaagaagagagcggaatcccaaaggttgcggacccatgggggggcagttacatgatggagtgtcttactaacgatgtgtacgacgcagccttaaaactgataaatgagatcgaagagatgggaggcatggccaaggccgtggccgagggaataccgaagctaagaatagaggagtgtgctgcaagaaggcaggcccgaattgattctggcagcgaggttattgttggagttaataaatatcagctggaaaaggaagacgctgtcgaagtgctggcaatagacaacacctccgtgcgcaaccggcagatcgagaaactgaagaagatcaagtcatcccgggaccaagccctggcggaacgttgtcttgcggcgctcacagaatgtgctgcgagtggggatggaaacattctggccctagccgtcgatgcaagccgcgctcgatgtaccgtgggtgagattactgatgccttgaaaaaagtattcggcgaacataaggctaatgacagaatggtgtcaggagcctaccgccaggaatttggcgagagcaaagaaatcacaagcgccatcaagagggtccataaatttatggaacgcgaggggcggagaccacgcctgctggtggccaaaatggggcaagatggtcacgatcggggagccaaagttatcgctactggattcgcagatttaggctttgacgtggatatcggaccactctttcagaccccccgcgaggtcgcgcagcaggcagtcgatgctgatgtccatgccgtaggggtgtccaccttagctgctggccacaaaactctcgtgccagaactgatcaaagaactgaatagcttgggtagaccagatattttggtgatgtgtggaggcgtgatcccaccacaggattatgagttcctttttgaggtgggggtgtctaacgtttttggtccaggaaccagaatcccaaaggctgctgtgcaggtgctggatgatattgagaagtgcctcgaaaagaagcagcagtctgtc

SEQ ID NO: 93 - DNA, 2250 bp, Artificial Sequence
  Codon optimized sequence that encodes an MCM polypeptide with the I671V mutation
atgctgcgtgccaaaaatcagctttttttgctctccccacattacctgcgacaggtcaaagagtcctccggtagccgactgattcaacagagattgcttcatcagcagcagccgttacatcccgagtgggcagctctggcaaagaaacagctgaagggcaagaatcctgaggatctcatttggcacacgccagagggaatctcaattaagcccctgtatagcaagcgcgacaccatggatcttcctgaggagctgcctggagtgaagccttttactaggggaccctaccctaccatgtatacttttcggccttggacaattcgacagtacgcaggattctccacagtcgaggaaagtaataaattttacaaagataacatcaaagccgggcagcaggggctgtctgtggctttcgatctggccacccatcggggatacgattcagacaatcctcgggtccgaggggatgtcggcatggcgggggtggcgatagacacagtggaggatacgaaaattctgttcgacggcattcctctggagaagatgtctgtcagcatgaccatgaacggggcagtaatccccgttttggcgaatttcatagttactggggaagaacagggagtacccaaagagaagctcacaggtaccatccaaaacgatatattgaaggaattcatggtcaggaatacgtacatcttccctccagaaccatcgatgaaaataatcgctgacatttttgaatatactgccaaacatatgcccaagtttaacagtattagcataagtggataccacatgcaggaagccggcgccgacgccattctcgagcttgcttacaccttggctgacgggctggaatactctcgtactgggttgcaggctggcctcactattgatgaatttgcacctcggctttccttcttctgggggataggcatgaacttttacatggaaatcgccaaaatgagagccgggagaaggctgtgggcccatctgattgagaagatgtttcagcctaagaattcgaagagtttactcttgcgggcccattgccaaacgagtgggtggtctcttacggaacaggatccttataacaatatcgtccggacagccatcgaggctatggccgccgtttttggtggcacccagtcccttcataccaattctttcgacgaagctcttggattaccgaccgtgaaatccgcccggattgcccgcaatacccagatcatcattcaggaagaaagtgggatccccaaagtcgcagatccttggggaggaagctacatgatggagtgcctgacgaacgatgtctacgacgccgcacttaagttgatcaatgaaattgaggaaatgggaggcatggccaaagcggtggctgaggggatacccaagttacggatagaagagtgtgctgccagaaggcaggctcggatcgatagcggctcagaggtcattgtgggagtgaacaagtaccaattggaaaaagaggatgctgtggaagtgctggcaattgataatacctcagtccggaatagacagattgagaagcttaaaaaaatcaagtctagccgagaccaggcgttagccgagaggtgcctcgcggctctcaccgagtgtgccgcctcgggtgacggcaacatcctggcccttgccgtcgatgcctcccgggctcgctgtaccgtgggtgagattactgacgcactcaaaaaagtatttggggaacataaagctaatgatcgcatggtctccggtgcgtaccgtcaggaattcggcgaatcaaaggagattacatccgcgataaaaagggtccataaatttatggaacgagaggggcgccggccgcgcctgctggtggcaaaaatgggacaggatgggcatgatagaggcgccaaggtgatcgccacaggcttcgctgatcttggtttcgatgtagacattggacccctcttccagacccccagagaagttgcccaacaagccgtagatgccgacgttcatgcggtaggcgttagcaccctcgccgccggccacaagacgctggtgccagagctgattaaagaattaaactcactgggaaggcctgatatactggtgatgtgtggcggggtgatcccgccccaggattacgaattcctatttgaggtgggggtttccaatgtttttggcccagggactcgaattcccaaggctgctgtacaggtgctagacgatatagagaagtgcctggagaagaagcagcagtctgtg

SEQ ID NO: 94 - DNA, 2250 bp, Artificial Sequence
  Codon optimized sequence that encodes an MCM polypeptide with the I671V mutation
atgttgagagccaagaatcaactctttctcttatcaccccactacctgagacaagtgaaagagtcgtctggcagtcgactgattcaacaaagattactccaccaacagcagcctctgcacccagagtgggccgccctggctaagaaacagctgaaggggaaaaaccctgaggacctgatatggcacacacctgaaggcatctccattaaaccattgtatagtaaaagagataccatggatctgcctgaggagcttcctggggtgaaaccgtttactaggggtccataccccaccatgtatacttttcgcccttggacaatcaggcagtacgcgggattttcaacagtggaggagagtaataagttttataaggataatatcaaagcgggacagcagggtctcagcgtagctttcgacctggccacacatcgtggatacgattccgataacccaagggtgcggggggatgtggggatggctggtgtggccatcgacaccgttgaagatactaagatcttgtttgatggaattccccttgaaaagatgtcagtcagcatgacaatgaatggggccgtcatcccagtgctggccaatttcatagtgacaggggaagagcagggagtcccaaaggagaaactcacagggaccatccagaacgacatcctcaaggaatttatggtccggaatacatacattttccctccggaaccctcaatgaagatcatcgctgacatcttcgagtacaccgctaaacatatgcctaaattcaattctatctcaatcagcggatatcacatgcaggaggcaggagccgacgctattctagaactcgcgtacactctggcagatggtctcgaatactcccggaccgggctccaagctgggttgaccattgacgaatttgcgcctcggctgagctttttttgggggattggcatgaatttctacatggagattgcaaaaatgcgtgccgggcgaagattatgggctcatctgatagaaaaaatgtttcagccaaagaatagcaagagtcttctgctgagagcacattgtcagacatcaggatggtccctgacagagcaggatccttataataatatcgtgcggacagcaattgaggcaatggctgctgtatttggtgggacccaaagtttacacacaaatagcttcgatgaggctctcgggcttcccaccgtcaagtctgctcggatcgctagaaacacgcagattatcatccaagaagaaagcggaatccccaaagtggcagacccttggggtgggtcatacatgatggaatgtctgactaacgatgtctacgatgctgcactgaagctgattaatgagatagaggagatggggggaatggccaaagccgtggctgagggcatccctaagttgcggatcgaagaatgtgccgcacgtagacaagccaggatagatagtggtagcgaggttatcgtcggagtgaataagtaccagctagagaaagaggacgccgtggaggtgttggcaattgataacacctccgttagaaacaggcagatcgagaaactaaaaaagattaaatcatcgagagaccaagctttggccgaaaggtgtctggctgcgctcacagaatgcgccgcttcaggcgatggcaacatcctggcactggctgttgatgcgtccagggctcgctgtaccgttggcgaaatcacagatgctctcaagaaggtctttggtgagcacaaagcaaacgaccggatggtctccggagcttaccggcaggaatttggagaaagcaaggagattacctcagctatcaaaagggtgcataagttcatggagcgtgaagggcgccggcccaggcttctggtggctaaaatgggccaggacggccatgaccgaggagccaaggtcatcgccacagggttcgccgatctaggctttgatgtggatatcgggcccttattccagactcctcgcgaggtagcacagcaggccgtcgatgccgatgtgcacgcagtgggcgtatctacactcgcggctgggcataagacgctagtacctgagctgatcaaggagctgaactccctgggcaggcccgatattctggtgatgtgtggcggggtgataccccctcaggattatgaattcttatttgaagtgggcgtcagtaatgtttttgggcctggtactcggatcccaaaggcggcagtgcaagtcttagatgacattgaaaaatgtctcgagaaaaagcagcagagcgtc

SEQ ID NO: 95 - DNA, 2250 bp, Artificial Sequence
  Codon optimized sequence that encodes an MCM polypeptide with the I671V mutation
atgctgcgagcaaagaatcagctgttcctcctgtccccacactatctacgccaagtgaaggagtcgagcggatctaggctaatccaacaaagactgctgcatcagcagcaaccactgcacccggaatgggctgcgctcgctaagaaacagctgaaaggtaaaaacccagaggatcttatctggcacactcccgaaggtatcagcattaaacctctttacagtaagcgcgatactatggacctccccgaagaactaccaggcgtgaaaccgtttactcgaggcccataccccaccatgtacacatttaggccttggacaatacgacagtacgccggattctcaaccgtggaagaaagcaacaaattctacaaagataatatcaaggcgggccagcagggattgagtgtagccttcgacctggcgacccacagagggtatgactccgacaacccccgggtgcggggcgacgtcggaatggcaggggtcgcgattgataccgttgaagatacgaagatcttatttgacgggattccactagaaaagatgtcagttagtatgacaatgaatggagccgtgattcccgtgctggccaactttatcgtgaccggagaagagcagggagtgccaaaggaaaagctgacaggaacaatccagaacgatatattaaaggaatttatggtgagaaacacatatatatttccacctgaaccctctatgaaaataatagcggatatattcgaatataccgccaaacatatgcccaagttcaactccatttccatcagtgggtaccacatgcaggaggccggtgccgatgcaattctcgagctcgcatatactctggctgatgggttggagtattcacggactggattgcaggcaggactaactattgatgagttcgcacccagactatcctttttttggggaatagggatgaatttctacatggaaattgcgaaaatgcgggccgggcggcggctatgggcgcacctgatcgagaagatgtttcaacccaagaacagtaagtccctgctcctcagagcacactgccagacatcaggctggtctcttaccgagcaggacccttataataacatagttcgtacagccattgaagctatggctgcagtatttggcgggacccagagtctgcatactaattcattcgatgaagcactggggttacctaccgtgaaaagcgctcgaatcgcaaggaacactcagatcattatccaggaagagagtggcatccctaaagtggccgatccctggggcggctcatatatgatggagtgcctgactaatgatgtgtacgacgctgctttgaaactgataaatgagatcgaggagatgggcggcatggccaaagccgtggccgaagggatccctaagttacggatcgaggagtgtgccgctcggcgacaggctcggatcgactctggctccgaggtcattgtcggcgtaaacaagtatcagctggaaaaggaggatgccgtggaggtgctcgcaatcgataacactagtgtgaggaatagacagattgaaaaactgaaaaaaattaagagcagccgagaccaagcccttgctgaaagatgcctcgccgcactcaccgaatgcgcagcctcaggcgatggcaatattcttgccttggcagtggacgcatcaagggcacgctgcaccgttggagaaatcaccgacgcacttaaaaaagtgttcggtgaacataaggccaatgaccggatggtcagcggcgcctataggcaggagtttggagagagtaaagaaattacttccgccatcaagcgcgtccacaaattcatggagcgggagggccggcgccccaggctgctggtggcaaaaatgggacaggatgggcacgatcggggagccaaagtgatagcaactgggtttgcagatctcggcttcgacgtggatatcgggcccttgttccagacgcctagggaggtggctcagcaggctgttgacgcagatgtccacgctgtgggcgtctcaactctggctgccggccataaaacccttgtgcctgagctgatcaaggagctgaatagtctgggtaggccggatatcctggtcatgtgtgggggggtcatccctccccaggattatgaatttctcttcgaggtcggcgtatctaacgtcttcggcccaggaacgaggatccccaaggcggccgtgcaggtacttgacgatattgagaaatgtcttgaaaagaaacagcagagtgtg

SEQ ID NO: 96 - DNA, 2250 bp, Artificial Sequence
  Codon optimized sequence that encodes an MCM polypeptide with the I671V mutation
atgctgcgtgccaaaaaccaactgtttctcctatcgcctcactatctccgccaggttaaggaatcttcgggctcccggctaatacagcagagactgctacatcagcagcaacctctacatccagagtgggcagcgctggcgaagaagcagctgaagggaaagaacccagaggatcttatctggcatacccccgaggggatatctattaaaccactgtacagcaaacgagacaccatggatctgccagaagagcttccgggggtgaaaccattcacacggggaccatatccaacaatgtacacgttccggccatggaccatccgacagtacgccggcttttcaactgtggaggaatccaacaagttttacaaggataatattaaggcaggacagcaggggctgtctgtcgctttcgacctcgccacccaccgcggttacgatagcgacaacccccgcgtcaggggggatgtcggcatggctggcgtggccatcgacaccgtcgaagacaccaagatcctgttcgatggaatcccgctggaaaaaatgtcagtaagcatgaccatgaatggcgccgtaatccctgtactggcaaactttattgtgacaggcgaagagcagggagtccctaaggagaagctgacagggaccatacagaatgatattcttaaagagttcatggtgagaaacacttatatttttcctccagagccttcaatgaaaataatagccgatatctttgagtacaccgccaaacatatgcccaagtttaatagcatttctatatccggttaccatatgcaggaagcaggtgcagacgctattctggaattggcctacaccctggctgatggacttgaatacagccgcaccggactccaggccgggcttacaattgacgagttcgccccacgcttgtcctttttttggggtattggcatgaacttctacatggagatagccaagatgcgtgccggtcggaggctgtgggcacacttgattgagaaaatgttccagcctaagaattctaagtctctgcttctgagggcccactgtcagactagtggttggtcactgaccgaacaggatccgtataataacattgtgcgcacggccattgaagccatggcggccgtttttggcggcacacagagcctccacaccaatagcttcgacgaggctctgggtctgcctacagtgaaatcggcccggatcgctagaaacacacagatcattattcaggaagaaagcggcataccaaaagtggccgacccttggggcggctcttatatgatggaatgtctgactaatgatgtttatgatgccgccttaaaactcattaatgaaatcgaagaaatggggggcatggctaaggcggtggccgagggcataccaaaactgaggatagaagagtgcgccgcccggcgacaggccaggattgatagtggttctgaggttatcgttggcgtaaacaaatatcagctagagaaagaggacgccgtggaagtcctggccatcgacaacacgagcgtacggaacaggcagattgagaagctgaaaaagataaagagcagtcgcgaccaggcactggcggagcgatgcctggccgcactgaccgagtgcgctgcaagtggcgatggcaatatcctggctctcgcagttgatgcctccagggccagatgcaccgtgggagagatcacagatgcccttaaaaaggtatttggagagcataaggccaacgaccgcatggtctctggggcgtacagacaagagtttggagagtctaaagagattacatccgccattaagagagtacacaagtttatggagcgcgaaggaaggcgtccccgcctgctggtagccaagatgggccaagacggccatgatagaggcgctaaggttatcgccactggcttcgcagatttaggatttgacgtcgacatcggacccttgtttcagacccccagagaggtcgctcagcaagctgtggatgctgacgtccatgcagtgggggtctcaacgctggcagcgggacataaaactctcgtgcctgagttgatcaaggaactcaattccctggggcgccctgatatccttgttatgtgtggtggagtcattcctccccaagattatgaatttctattcgaagtgggcgtctctaatgtctttggccctgggacaaggattccaaaggcagctgtgcaggtgttagacgatatagaaaaatgtctcgaaaagaaacagcaatccgtg

SEQ ID NO: 97 - DNA, 2250 bp, Artificial Sequence
  Codon optimized sequence that encodes an MCM polypeptide with the I671V mutation
atgttgagggccaagaaccagttgttcctcctgtctccacactacctgcgacaggtcaaggagagcagcggaagccgactcattcagcaaagactcctccaccagcagcagcccctgcaccccgagtgggccgcactggctaagaaacagctgaaaggaaagaacccagaggatctcatatggcatacgcctgaggggatcagcattaagcccctttacagcaagagagatactatggaccttcccgaagagcttcccggggtgaaaccattcacacggggtccctatccgaccatgtacacgttccgtccctggactatccggcagtatgctggattttctaccgtggaggagtccaacaagttttataaggataatatcaaagccgggcagcagggcctttccgttgcttttgacctggccacccatcgcggctacgattcagataaccctcgcgtaaggggtgatgtgggaatggccggtgtagcaattgacacggtggaagacacaaaaatcctgttcgacggtatccctcttgagaaaatgtccgtctcaatgaccatgaacggcgctgtgattcccgtactcgccaacttcattgtgacaggcgaggaacagggcgtccccaaagagaagctaaccggaaccattcaaaacgacatcttaaaggagttcatggtccgcaacacctacatattcccacctgaaccctccatgaagatcattgcagatatttttgaatacaccgcgaagcacatgcctaaatttaactctattagcatctccgggtaccacatgcaagaagcgggggctgacgccattctggagctcgcttacactttggcggatggactggaatacagcagaacggggctccaagctgggctgactattgacgagtttgcaccccgcctcagcttcttttggggcatcgggatgaatttctatatggaaattgctaagatgcgggctggccgtagactctgggcacacctcatcgagaaaatgtttcaaccaaagaactctaagagtctactgctcagggctcactgtcagacctccggctggagtctcacagagcaggacccttataataacattgtcaggacagcaatagaggctatggctgccgtcttcggcggtacccagagcttgcacaccaacagcttcgatgaagcactcggcctgccaacagtgaagtcggcgcggatcgctagaaacacccagatcataattcaggaggagagtggtattccgaaggtcgcagatccatggggggggtcctatatgatggagtgcctaacaaatgatgtatacgacgcagctttgaagctgatcaacgagattgaagaaatgggaggcatggccaaagcggtggcggaggggattccaaagcttcggattgaagagtgcgccgcccgccggcaggcccgaattgactcaggctcagaagtcattgttggcgtcaataaataccagctggaaaaggaggacgccgtagaagtgctcgctattgataatacatccgtgagaaacagacagattgagaagctgaagaaaataaagagctctcgcgatcaggctttagccgaaaggtgtctggctgcacttaccgagtgtgcagcgtccggagacggtaacattctggccctagcagtggatgctagcagagcccgctgcacagtgggcgagatcacagatgctttaaaaaaggtgtttggagaacataaggcaaatgaccgcatggtctcgggagcttatcgccaggaattcggcgagtctaaagagattacaagtgctattaaaagagtgcataagtttatggagcgggagggtaggaggcctcgattattggttgccaagatggggcaggatgggcatgaccggggagcgaaagtcattgcaactggctttgctgatctgggatttgatgttgacataggaccgctgttccaaactccacgcgaagtagcccagcaggctgtagatgcggacgtgcacgccgtgggggtttccaccctggctgcaggacataagacactggtgcctgaacttattaaggagctgaactccttagggaggcccgatatccttgttatgtgtggcggtgtgatccccccacaggactatgaatttctgtttgaagtaggcgtgtcaaacgtcttcggccccggcacacggatcccgaaggctgccgttcaagtcttggacgacatcgaaaagtgcctcgaaaagaagcaacagtctgtc

SEQ ID NO: 98 - DNA, 2250 bp, Artificial Sequence
  Codon optimized sequence that encodes an MCM polypeptide with the I671V mutation
atgcttagagccaagaaccagctgtttctcttgtctcctcattatcttagacaggtcaaagagagtagcgggtcgaggcttatacagcagcggcttctacatcagcagcagcctctgcaccccgagtgggcggcactagcaaagaagcaactcaaaggcaaaaatccagaggaccttatttggcacacgcctgaggggatatcgatcaagccgctttacagcaagcgcgacacaatggacctcccagaagagctccctggcgtgaaaccattcacccgcgggccctaccctacgatgtatacgttccgcccctggaccataagacagtatgccggttttagcactgtcgaagagtctaataagttctacaaagataatattaaagctgggcagcagggactgtccgtcgcttttgacctggcgacccatcgtgggtacgatagcgacaatccgcgcgtccggggcgatgttgggatggcaggcgtcgcaatcgatactgtggaggacaccaagatcctgtttgacggcatccccctggagaagatgtcagtgagcatgacaatgaacggtgctgtcatccccgtgctcgcaaactttatcgtcacgggagaagagcagggtgtgccgaaggagaagttaacagggaccattcagaacgatatcctgaaggagtttatggtcaggaacacctatatttttccacccgagccatctatgaagattatcgccgacatatttgaatatactgcaaagcatatgcctaaattcaatagtatttcaatctcgggctatcatatgcaagaggccggggccgatgcaatactggagcttgcttatacgttagctgacgggcttgagtatagtaggacggggcttcaagctggactgaccattgatgaattcgctcccaggctgtccttcttttgggggatcggtatgaatttctacatggagatcgccaagatgcgagctggccgcagactatgggcacacctcatcgagaaaatgtttcaaccaaaaaactccaaatcccttctcctacgggcgcattgccagaccagcggatggagcctcactgagcaggatccatataataatatagtgaggaccgctattgaggctatggctgccgtgtttggcggaacccagagcctgcacaccaactccttcgatgaagccctggggctccccacggttaaaagcgcgagaatcgctcggaacacacagattattatacaggaagaatctggtatccctaaggtggctgatccttggggcggatcctatatgatggaatgcttgacaaatgacgtgtatgatgccgccctgaagcttatcaacgaaattgaagagatgggcggcatggccaaggcagtagccgaaggcatccctaaactgcggatagaagagtgcgctgcacgccgtcaagctagaatcgacagtggcagtgaggttatcgtcggcgtcaacaagtatcagctggaaaaggaggatgccgttgaggtattggcgatagacaataccagcgtccgtaacaggcagattgaaaaactgaaaaagatcaagagctcacgcgatcaggctctagccgaaagatgcttagccgccctgacggagtgtgctgcaagcggcgacggcaacatcttggccctggccgtagatgccagcagagctcgctgcaccgtgggtgagatcactgatgccttgaaaaaggttttcggggaacataaggccaatgaccgcatggtgtccggcgcataccgacaggaatttggagagagtaaagagattacttcagccataaaacgtgttcacaagtttatggaaagagagggtaggagaccgcggctgctagttgcaaaaatgggccaggatggccacgacaggggtgctaaggtgatcgcgaccggatttgcagacttgggcttcgatgtggatattggcccgctgttccaaactccgcgagaagtggcccagcaagcagtcgatgccgacgttcatgcagtcggcgtcagtactctggccgccgggcacaagactttagttcccgaacttatcaaggagctcaatagtttggggagaccagacatcctggtgatgtgcggaggagttatccctccacaagactatgaattcctgtttgaagtgggcgtgtccaacgtcttcggccccggaacacgaatacccaaggcggcagttcaggttcttgatgatatcgagaagtgtttggagaaaaaacagcagtccgtg

SEQ ID NO: 99 - DNA, 2250 bp, Artificial Sequence
  Codon optimized sequence that encodes an MCM polypeptide with the I671V mutation
atgctgagagccaaaaatcagttgttcttgttaagtccacattacctgaggcaggtcaaagagtcaagcggcagcaggctcatccaacagagactgttgcatcaacagcagcctctccaccccgaatgggccgcacttgccaagaaacagttgaaaggcaagaaccccgaggaccttatctggcatacaccagagggaatcagcatcaaacccctatacagcaaaagggacactatggaccttccagaggagctcccaggcgtcaaaccctttacacgtggtccctatcctacgatgtacaccttcagaccttggaccatccgccagtacgccggctttagtacggtagaagagagcaacaagttttacaaagataacataaaagctgggcagcaaggactgtccgtggccttcgacctagcgactcaccggggctacgactccgacaatccaagggtccgtggcgatgtagggatggccggggtggcaatcgatactgtagaagatacaaaaattttgtttgacggcatccccctggagaagatgtcagtttccatgactatgaatggggccgtgatccccgtgttggcgaatttcatagtgacaggggaagaacagggagtacccaaggagaagctcacggggacgatccagaacgacatcttgaaagaatttatggtgcgcaatacttacatcttccccccggaaccttctatgaagatcattgccgacattttcgagtatacagctaagcacatgccaaaatttaattcaatctctatttcaggataccatatgcaggaggccggcgccgatgccatcttggagctagcctataccctcgctgatggactggaatactcaaggactgggttgcaggcgggactaacaatcgacgaattcgccccacgtcttagctttttttgggggattggaatgaacttctatatggaaatagcaaaaatgagagcgggcagaagactctgggcgcatctcatcgaaaaaatgttccaacccaagaattccaagagcctcctgctgagagctcattgccagacatctggctggtcgttaaccgaacaagacccctataacaacatcgttcgcactgccatcgaggccatggcggcggtattcggtggaacacagtcgctgcacacaaacagtttcgatgaggcccttggcctcccaactgttaagtctgcgagaattgcccggaacacgcagattataatacaggaagagtctggcattccaaaggtcgcagacccctgggggggatcctacatgatggaatgtctgacaaatgacgtttatgatgcggcccttaagttgataaacgagatcgaagaaatgggaggcatggctaaagccgttgcagaaggcattcccaagctgcgcatcgaggagtgcgccgctaggaggcaggctaggatagactcaggcagcgaagtcattgtaggcgtgaataagtatcagctcgagaaggaggatgcggtggaagtgcttgcgatcgacaatacctctgttcgcaaccggcaaatagaaaaacttaagaaaatcaagtcctcccgcgatcaggctttagccgaacggtgcctggccgctttaacggagtgcgccgcttcgggggacggtaatattctggctctcgccgtagacgcctccagagccagatgcacggtgggtgaaataacggacgctctgaagaaggtgtttggggaacacaaagcgaacgaccgcatggtgtcaggtgcttaccgacaggaatttggtgagagtaaagagatcaccagcgccattaaacgggtgcataagtttatggagcgagaaggccgtagacctaggctactggtggctaagatgggacaggatggccatgaccgcggggcaaaggtcatcgccaccggctttgctgaccttgggttcgacgtcgacattggtcccttgttccagacccctcgggaagtggcccagcaagccgtggacgctgacgtgcacgctgtgggcgtgtcaacactggccgccggacacaaaactcttgtccccgaactgatcaaggagctgaactcattggggcggcccgatattttggtgatgtgtggaggagtcatcccacctcaagactacgagttcctattcgaagtgggcgtctctaacgtctttgggcctggtactcgcatcccgaaagcggccgtgcaagttttagacgacatagaaaaatgcctggagaaaaagcagcagtccgtt

SEQ ID NO: 100 - DNA, 2250 bp, Artificial Sequence
  Codon optimized sequence that encodes an MCM polypeptide with the I671V mutation
atgttgcgggctaagaaccaacttttccttctctctccccactacctgagacaggtgaaggaatcaagcggctcccgactgatccagcagcgactgctgcatcaacagcaacccctacatccggaatgggccgcgctcgctaagaaacaactgaagggcaaaaatcccgaagatttgatctggcataccccagagggcatttcaattaaacctctctatagtaagagagacactatggacctgccggaggagttgcctggggtcaagccatttacccgggggccataccccacgatgtatactttccgcccatggacgatccggcagtatgctggtttttcaacggtggaagagtcgaacaagttttataaagataatatcaaggccggccaacaggggttaagtgtcgcctttgatctggccacgcaccgtggatacgacagcgataatcctcgcgtgagaggcgatgtggggatggcaggggtcgccattgacaccgtcgaagacactaagatcctcttcgatgggatccccttagagaagatgagtgttagtatgacaatgaatggagcagttatacctgttttggccaatttcatcgtaaccggcgaggagcaaggggttcctaaggagaagctcacaggtactatccagaacgatatcctgaaggagttcatggttcgcaatacctatatctttcctccagagcccagcatgaaaatcatcgcagatattttcgagtatactgctaaacatatgccaaagtttaattcaattagcattagcggatatcacatgcaagaagcaggggccgatgcaatcctggagctggcgtatacgcttgccgacggcttagaatactcacggacaggactgcaagcaggactgactattgatgagttcgcccctcggctgtccttcttttgggggattgggatgaatttctatatggaaattgcaaagatgcgcgcgggccgacgactgtgggcccatctaatcgaaaagatgtttcagcctaagaactccaagtctttactgctgcgtgctcactgccagactagtgggtggtcattgacagagcaggacccatataacaatatagtgaggaccgcaatcgaggctatggctgccgtcttcggaggaacgcagagcctccatactaacagctttgatgaggccctgggccttcccactgtaaagagcgcccgcatcgcaagaaacactcagatcattatccaggaagaatctggaatccccaaagtcgcagacccctggggcggctcctatatgatggagtgcttgactaacgacgtgtacgatgccgccctcaagctgattaatgaaatcgaagagatgggcgggatggccaaagcggttgctgagggtatccccaaactgcgaatcgaagagtgcgctgcacgccgccaggctcgtatagattccgggagcgaggtaattgttggggtaaacaaataccagctggagaaggaagacgctgttgaagttctagctattgacaacacatccgtccggaatcggcagatcgagaaacttaagaagattaagagtagtcgcgatcaggccctcgcggaaagatgtctggccgccctgaccgagtgcgccgcaagcggtgatggcaatatactggccctcgctgtggatgccagccgagcccggtgcaccgtgggcgagattactgacgccctgaagaaagtgttcggggaacacaaggccaacgataggatggtgagtggcgcctatcggcaggagttcggagagtctaaagaaatcacaagtgccatcaaacgcgtgcacaaattcatggaaagagaaggtcggcgcccgcgtttgctggtggcaaagatgggtcaggatggtcatgaccggggcgctaaggtcattgccaccggcttcgctgacctaggattcgacgtggacatcgggcccctgttccagacccctcgggaggtggctcaacaagccgtggacgccgatgtacacgctgtgggtgtttctaccctcgcggctgggcataaaacattggtgccagaactgattaaggaactgaatagtctgggccgcccggatattttagtcatgtgtggtggagtgatccccccgcaggactacgagttcctatttgaggtgggagtgagcaatgttttcggccctggcactaggattcctaaagccgccgtgcaggtgttagatgacattgagaaatgcctcgagaaaaagcaacagtctgtg

SEQ ID NO: 101 - DNA, 2250 bp, Artificial Sequence
  Codon optimized sequence that encodes an MCM polypeptide with the WT mutation
atgctccgcgctaaaaatcagctgtttctactgtctccgcattaccttcggcaagtcaaagaatcctctggcagccgactcattcaacagcgcctgctgcaccagcagcagcctctccatcccgagtgggctgctctggccaagaagcagctcaaggggaaaaatcctgaggatctgatctggcatacccccgaagggatcagcatcaagcctctgtactctaagcgggataccatggatctgccggaagagttacctggcgtgaagcctttcaccagggggccttatccgacaatgtataccttcagaccttggaccattcggcagtacgctggattcagcaccgttgaagaatctaataagttttataaagataatattaaagcgggacaacaggggctgtcagtggccttcgatctcgctacccaccgtggttacgacagtgataaccctcgagttagaggtgacgtgggcatggcgggcgtagccatagacaccgtagaagacaccaagattctgttcgatggcatccctctggaaaagatgagcgtctctatgaccatgaatggggccgtcattccagtgcttgccaactttattgtcacgggcgaggagcagggggtccccaaagaaaaactgaccgggactatccagaacgatattctgaaggaattcatggttcggaatacctacatcttcccaccagagccaagtatgaaaataatcgcagatatcttcgagtataccgctaagcacatgcccaagttcaactctatttctatttcaggctaccatatgcaggaggccggcgccgacgcaatccttgaattagcctatacactagctgatggactcgagtatagtcgtacgggtttgcaggccgggctaaccattgacgagttcgcccctcgactttccttcttctggggaataggaatgaacttctatatggaaatcgccaagatgcgagccggaagacgactgtgggctcaccttatcgaaaagatgttccagcccaaaaacagcaagtccctgcttctgcgcgctcactgccagacgagtggctggagtcttacagaacaggatccatataacaacattgtgcggactgcgatcgaagccatggccgccgtattcggagggactcagtcattgcacacaaacagctttgacgaggccctgggcttgcccacagtgaaaagcgctaggattgccagaaacacgcagatcatcatccaagaagagagtggcatacctaaggtggccgacccctgggggggatcctatatgatggaatgcctgacaaacgatgtgtacgatgccgctcttaagctgattaacgagattgaagagatgggcgggatggcaaaagccgtggccgaggggatccccaagttgcggatcgaggagtgtgcagctcgaagacaggctcgaattgatagcggcagcgaagtgatagtgggcgtaaataaataccaacttgagaaggaggatgcggtggaagtgctagccatcgataacaccagcgtgcggaaccgacagattgaaaaactgaagaagattaaatcttcacgggaccaggctctagccgagcgttgtctcgcggcgctgaccgagtgcgcagcgtctggagatggcaatattctcgcgctcgctgtggacgcgagtcgggcgcggtgtaccgtgggcgagatcacggatgctctcaaaaaggtttttggcgagcacaaagccaatgatagaatggtgagcggggcttacaggcaagaattcggggaatcaaaagagatcacctccgccattaaaagggtccacaagtttatggaacgggagggaaggcgccccagactgttagtcgcaaagatgggtcaggatgggcacgatcgcggtgcaaaagtgattgccaccggcttcgccgatctgggcttcgacgttgatatcgggcctctgttccagaccccaagagaagtggcacaacaggcggtagatgctgacgtccacgccgtcgggatatctactctggccgcagggcacaaaacattagttccggagctcatcaaagaactgaattcgctcggacggccggacattctcgtgatgtgtgggggggtgatccctccccaggactacgagttcctcttcgaggtgggagtgagcaacgtcttcgggccaggtacacgtatacccaaagcagctgttcaggtgctagatgacatcgagaagtgcttagaaaaaaagcaacagtcagtc

SEQ ID NO: 102 - DNA, 2250 bp, Artificial Sequence
  Codon optimized sequence that encodes an MCM polypeptide with the WT mutation
atgctgagagcaaaaaaccaactcttccttctgtctccacactatctccggcaggtgaaggagtccagtggctccagactgattcagcagcgacttctgcaccagcagcagccacttcatcccgagtgggccgccttggcaaaaaaacaactgaaaggtaagaacccggaagatttaatttggcatacaccggaaggaatttctatcaaacccctgtactctaagagggacacaatggatctgccagaggagctgcctggggtcaagcccttcacgagaggcccctaccccaccatgtatacgttccggccttggacaatcaggcaatacgccgggttttcaacagtggaagagtcgaacaagttttacaaagacaatattaaggccggacagcagggcctttccgtagcattcgatctggcaacacaccgcgggtacgatagtgataacccccgggttaggggcgatgtaggtatggccggggtagctattgacaccgttgaagacaccaagatcctttttgatggcatcccactcgagaagatgtctgtgagcatgacaatgaatggggcggtgataccggtcctggcaaacttcattgttactggtgaggagcagggcgtgcccaaggaaaagttaaccggaaccatacagaatgatatcctcaaagagtttatggttagaaatacctacattttcccacccgagccttctatgaaaatcatagccgacatctttgagtataccgctaagcacatgccaaagttcaactctatttccatctcaggatatcatatgcaggaagccggcgccgatgcgatcctagaactcgcctacacactggcggatggactcgaatattctcggaccggcctgcaggccggcttaaccattgacgagttcgcccccaggctgagctttttttggggcatcggaatgaacttttatatggagatcgcaaagatgcgggccggcagacgcctgtgggcccacctcatagagaagatgttccagcctaaaaatagcaagtcattactcctcagggcacattgccagactagcggatggtcattgactgaacaggatccttataataatatcgtacgtacggcaatcgaggcgatggccgcggtgtttggggggacccaatccctgcacactaattccttcgacgaagccctggggcttcctaccgtcaagtcggcaagaatcgccaggaacacccagattataattcaggaagaatccggtattcccaaggtcgcagacccgtgggggggctcttacatgatggaatgtttaaccaatgacgtgtacgatgccgccctaaagctgatcaacgaaattgaggaaatggggggcatggcgaaagccgttgcagagggcatcccaaaattaagaatcgaggaatgcgcggctcgccgccaggcgcgcatcgatagtggctccgaggtgatcgtaggggttaataagtatcagctggaaaaagaggatgcagtggaggttcttgctatcgataatacttccgtgaggaaccggcagatcgaaaagctgaagaagatcaagtccagccgtgatcaggctctggccgaacgctgcttggccgcactgacagagtgcgccgcctctggcgacggcaatatcctagccctggctgtggatgcgtcacgggcccgatgtacagtcggtgagataacagatgctcttaagaaggtcttcggcgagcataaggctaacgaccggatggtgtcaggtgcgtaccggcaagaatttggggagagtaaggaaatcacctcagcaataaagcgggtccataagttcatggaacgggaaggacgccgcccccggcttttagtggcaaagatgggccaggatggtcacgaccgcggcgcaaaagtgatcgctaccggattcgccgaccttggatttgacgttgatattggtcccttgttccagaccccaagggaggtggcccaacaagccgtcgatgccgatgtgcacgccgttggtatctctactctcgcagcagggcataagacactcgtgcccgagctcataaaggaactgaatagcctcggtcgaccggatatactcgtcatgtgtgggggcgtgattccccctcaggattatgagttcttgtttgaggtgggcgtgagcaacgtcttcggtccaggcaccagaattcccaaggccgctgtgcaggtgttagacgatattgaaaagtgcttggaaaaaaagcagcagagcgtg

SEQ ID NO: 103 - DNA, 2250 bp, Artificial Sequence
  Codon optimized sequence that encodes an MCM polypeptide with the WT mutation
atgttacgcgctaagaaccagctgtttctgctgagtccccattacttgagacaggtaaaggagtcatccgggagcagattgatacagcagcgtttgctgcaccagcagcagccactgcatccggagtgggccgccttagccaagaagcagttaaaggggaagaatcccgaggacctgatttggcacacacccgaagggatttctatcaagcctctctattctaaaagggacaccatggatctgcccgaagagctgccgggagtcaagcccttcacaagagggccataccctacgatgtatacattcagaccatggacgattaggcagtacgctggattcagtactgtggaagaatcaaataaattctataaggacaatatcaaggccggccaacaggggttatcagtggctttcgacctggctactcaccgaggctatgactccgacaatccccgggtccggggggacgttggaatggcaggagtggcaatcgatacagtcgaggataccaagatcctgttcgatggtatccctctggagaaaatgtctgtctccatgaccatgaacggggcagttatccccgtgctggctaatttcattgtaacaggagaggagcagggggtaccgaaggagaagcttaccggtacgatacaaaatgatatcctgaaagagtttatggtgaggaacacttacatcttcccacctgagccatctatgaaaataatcgcagacattttcgaatataccgccaaacatatgcctaagttcaactcaatcagcatctctggttatcatatgcaggaggccggcgctgacgccattctcgaactggcatatacactggcagacggactggaatacagccgtactgggttacaggctggtctcactatcgacgaatttgccccgcgactgagcttcttctggggtatcggcatgaacttttacatggaaatagcaaagatgcgtgctgggcgtcgcttatgggcacacctgatcgagaaaatgtttcagcctaagaatagtaaaagtttactcttaagggcacactgtcagacaagcggctggtctttaaccgagcaggatccctacaacaatatcgtgagaactgcgattgaggcgatggccgcagtttttggggggacacagtccttgcatacgaatagcttcgatgaggcactggggctgcctactgttaagagcgctaggattgctcgaaacactcaaatcatcattcaggaagagagcggaatccctaaggtagctgacccttggggtgggtcgtatatgatggagtgtctcaccaatgatgtgtatgatgcagcgttgaagcttatcaatgagattgaggagatgggcgggatggccaaggctgtggctgaagggatccctaaactgcgaatcgaagagtgtgcagcgagacgacaagcccggattgactccgggtcagaagtcattgtaggcgtgaataagtatcagctggagaaagaggacgcggttgaagtgctcgcaatcgataatacctctgtccgcaatagacagatcgagaaattgaagaagatcaagtccagccgggaccaggccctggccgagaggtgtctggccgccctgacggagtgtgcagcatcaggggatgggaacatactggctctggccgtcgatgcttcccgggcaagatgtaccgtgggcgagatcaccgacgcactgaagaaggtgttcggcgaacataaggcaaacgatagaatggtatccggcgcctaccggcaggagtttggagagtccaaggagatcacatctgccattaaaagggtacataaattcatggaacgggaaggtaggaggccaagactgctcgtcgctaagatggggcaggacggacatgacaggggtgccaaggtgattgctacagggttcgctgaccttgggttcgacgtggacataggccctctgtttcagacacctcgagaggtggcgcaacaggctgtcgacgccgatgtgcatgccgttgggatttctacgctggctgcgggtcataagaccctagtgccagaattaattaaggagttgaactccttggggaggccagacatcctcgttatgtgtgggggggtgattccccctcaagactacgagttcctgttcgaggtcggagtttctaacgtgtttggcccgggaacacggatcccaaaggccgccgttcaggtgttagatgacattgaaaagtgtctggagaagaaacagcaatcagtt

SEQ ID NO: 104 - DNA, 2250 bp, Artificial Sequence
  Codon optimized sequence that encodes an MCM polypeptide with the WT mutation
atgctgcgggcaaaaaaccaattgtttctgctatcccctcattaccttagacaggtcaaagaaagtagcggatctcgcctcatccagcaacggctcctgcaccagcagcaacccctacaccctgaatgggccgcactggctaaaaaacaactgaaaggaaaaaaccctgaagacttaatctggcacacccccgaaggcatttctatcaaacctctgtacagtaaaagagacaccatggatctgccagaagaactgcccggggttaaacctttcacccgcggcccttatcctactatgtatacctttcgaccatggactatccgccagtatgcaggcttctccactgtcgaagagtcaaacaagttctacaaggataatattaaggcaggtcagcagggactgtcagtagcttttgacttagctactcatagaggctatgatagcgacaaccccagagttagaggcgacgtaggaatggcaggagtggctatcgatacagtggaggacacaaagattctgtttgacgggattcctttggagaaaatgtccgtgtccatgaccatgaacggtgctgtgatccctgtcctcgctaattttatcgtgacaggggaggaacagggcgtgcctaaggagaagcttacaggtacaatacagaacgatattctcaaagaattcatggtaagaaacacttacatatttccaccagagccctccatgaaaatcattgcggatatctttgagtacactgcgaagcacatgcccaaattcaatagcatcagtattagcgggtaccacatgcaagaagctggggcagatgccatactggagctggcctatacgcttgccgatgggcttgaatattctcgcacaggcttgcaagcaggcctgactatcgatgagttcgctcccaggttgagtttcttttggggtataggcatgaacttttatatggagatcgcaaaaatgcgtgctggaaggcgattgtgggctcacctcatcgagaaaatgttccagccaaagaactcaaagtccctgcttcttcgggctcactgccagacctccggctggagtctgaccgaacaagacccatataataacattgttcggactgcaattgaagcaatggcagccgttttcggaggcacccagtccttgcacaccaatagctttgacgaggctctcggactgccaaccgttaagagtgctagaatagctcgaaatacacagataatcatccaggaagagtctggtattcccaaagtggccgacccttggggcggcagttacatgatggagtgtctcaccaacgacgtgtacgatgcggccctgaaattgataaacgaaatagaagagatgggtggcatggcaaaggcagtcgctgaagggatccctaagcttaggatagaagagtgcgcagccaggaggcaggccaggatcgattccggatcagaggtcattgtcggtgttaataagtaccaactggagaaggaggacgctgtggaagtactggcaatcgacaatacgtctgtgcggaacaggcagattgagaagcttaagaaaatcaaatcctcccgagaccaagcgctggccgagcgatgtttagcagctctgaccgagtgcgctgcatctggtgatggcaacattctggcactggccgtagacgcctcccgggccaggtgtacagtgggagaaatcaccgacgcccttaagaaagtgttcggggagcacaaggccaacgacagaatggtctctggtgcctaccgacaagagttcggagagtccaaggaaattacttctgccatcaaaagagtacacaagttcatggaaagagagggaaggagaccccgccttctcgtggctaagatgggccaggacggccatgaccggggcgcaaaggtgatcgctactggctttgccgatctcggttttgatgtagacatcggccctttgtttcagaccccccgagaagtcgctcagcaagccgtagacgctgacgttcacgctgtcggaattagcacacttgctgctggacacaagaccctcgttcctgaattaattaaggagctgaacagcttgggccgacccgacatcctagtgatgtgtggtggcgtgataccacctcaagattatgaattcctgttcgaagtgggagtttcaaacgtttttggccctggcactcggattccaaaggcagccgtgcaggtcctagatgacatcgagaagtgtcttgagaaaaagcagcagagcgtt

SEQ ID NO: 105 - DNA, 2250 bp, Artificial Sequence
  Codon optimized sequence that encodes an MCM polypeptide with the WT mutation
atgctgagagccaagaatcagttgtttttgttgtccccacattatctcaggcaggtgaaggagtcctccgggtcaaggttaattcagcagcgcttacttcaccagcagcagcccttgcaccccgaatgggccgcgctcgcgaagaagcagttgaaagggaaaaaccctgaagacctcatttggcatacccccgaaggcattagcatcaaaccactgtatagcaaacgggataccatggaccttcccgaagaactccccggagttaaaccttttactagggggccctaccccactatgtatacctttcggccttggactattcgacagtacgcgggattctccacagtggaggaatcaaataaattttataaggacaatatcaaagctggacagcagggcctgagcgttgccttcgacctcgcaactcacagaggctatgattcagacaatccgcgagtgcgcggcgatgtcggaatggctggagtagcgatcgatacagttgaagacactaaaattctattcgatggaattcccctcgaaaaaatgtccgtgtctatgactatgaacggggcagtgattccagttcttgccaatttcatcgttacaggtgaagaacagggagtgcccaaggaaaaactcacagggaccatccagaacgacatcctcaaggaatttatggtacgcaacacctacatatttccaccagaaccatctatgaaaataatcgctgatatcttcgagtatacagctaagcacatgcccaaattcaatagcatctctatttcgggctatcacatgcaagaggcaggcgccgatgccattctggaactcgcctacaccttggcggatggcctcgagtactctcggaccgggctacaagcggggctcacaattgatgaattcgctcctcgcctgtcttttttttggggaatcggtatgaatttctacatggaaatcgcgaaaatgcgagcaggtcggcgcctgtgggcccacctgatcgagaagatgtttcagcctaagaattcgaagtctctgcttctgcgcgctcactgtcagacatccgggtggagtttgaccgaacaggacccatacaataatatagtgaggactgccattgaagcaatggcagccgtgttcgggggtacccagtccctccataccaattctttcgacgaagccctgggactgcctaccgtgaagagcgccagaatcgcaaggaatacccagattattattcaggaagaatccgggatccccaaggtggccgacccatggggagggtcctacatgatggaatgcctcactaacgacgtgtatgatgcagcccttaaactgatcaacgagatagaagagatggggggaatggccaaggcggtagctgagggcatccccaagctccgcatcgaggagtgtgctgcccgcaggcaagccaggatagactccgggagtgaggtcattgtaggtgttaacaagtaccagctggagaaagaagacgccgtggaggtccttgccattgataataccagcgttaggaatcgacagatcgagaagctgaaaaaaatcaaaagttcaagagatcaagcattagcagaaaggtgtctggctgctttgacagagtgcgcagcctcaggggacgggaacattcttgcactcgctgtggatgcctcacgggctcggtgcactgttggcgagatcacagatgccctgaaaaaagtgttcggcgaacacaaagcaaacgatcggatggtgagtggagcctataggcaagagttcggcgagagcaaggaaatcacctcagccattaaaagggtgcacaagttcatggagcgagaaggccggagaccaagacttcttgttgcgaagatgggccaggacggccacgatagaggagccaaggtcatcgctactggattcgcagacctcggattcgacgtcgacatcgggcccctgttccagacaccccgtgaagtcgctcaacaagcagtggatgccgacgttcatgctgtcggcattagtacactggccgccggacacaagacccttgtcccggagttgattaaagagttgaactccctgggccggcctgacattttagtgatgtgcgggggcgtcattccaccccaggactacgaatttctgtttgaagtaggcgtgagcaacgtattcgggcctggcacacgaattccaaaagccgcagtgcaagtactggacgatatagagaagtgtctggagaaaaagcagcagtcagtg

SEQ ID NO: 106 - DNA, 2250 bp, Artificial Sequence
  Codon optimized sequence that encodes an MCM polypeptide with the WT mutation
atgctgagggccaaaaaccagttgttcctactgagccctcattatctcaggcaggtgaaggagagttccggttcccgtctgatccagcagcggctgctgcaccagcaacaacctctccaccccgagtgggccgctctggcgaagaagcaactcaaaggaaagaatccagaggatcttatatggcatacacctgaaggaattagcattaagcccctctattccaagcgtgacacaatggacctgcctgaggaattacctggagttaaacccttcacgcgcggtccctacccgacaatgtatactttccgaccctggactatcaggcagtacgcaggattcagcaccgtggaggagtcaaacaagttctataaggacaacatcaaggccggccagcaagggctttctgttgcattcgacctggccacgcaccggggttacgactcggacaatccaagggtccggggcgacgtcggcatggcgggagtggccattgacacagtagaggacacgaagattctatttgacggtatccctctcgagaagatgtccgtctcaatgaccatgaatggcgcagtcatccccgttttggccaatttcatcgtcaccggtgaggagcagggagtacctaaagagaagctgacgggaacgattcaaaacgatatactgaaggaattcatggtccgcaacacttatatttttccccccgaaccaagcatgaagataatcgctgatatatttgagtacacagcaaaacacatgcccaagttcaactccataagtatcagcgggtaccatatgcaggaggccggagctgacgcaatcctggaactggcatataccctggcagacgggttagagtacagcaggacaggcttgcaagcgggcctcacaatagacgaatttgccccacgattgtcatttttctggggcatcggaatgaatttttatatggaaatcgccaagatgcgggccggacggcggctctgggctcacctcatagagaaaatgtttcagccaaaaaattcaaaaagcctgcttcttcgggctcattgtcagacttcagggtggtccctgacggaacaggatccctataacaacattgtgcggacagctatagaagcaatggcggccgtgttcggcggcacgcagtccctacacactaatagtttcgacgaggccttgggcttgcctacagtcaaatccgccagaatagccagaaacactcagattataattcaggaagagagtggcatcccaaaagtggcagatccatggggaggatcctatatgatggaatgtctgaccaatgatgtctacgatgccgccttaaaactgataaatgaaattgaagagatgggagggatggcaaaggcagtggctgagggaattccgaaactgcggatcgaggaatgcgctgccaggagacaggcacggatcgattctggttccgaggtgatcgttggcgtcaataaataccagctcgagaaagaagacgccgtggaggtgctcgcgatcgacaatactagcgtccggaaccgacaaattgagaagcttaagaaaattaagagctcaagagatcaggccctggcagagcggtgcctagcagccctcaccgagtgcgctgccagtggtgatggaaatattctggccctcgctgtggacgcctctagagcgcggtgcacagttggcgaaatcactgacgctctcaagaaggtctttggagaacataaggccaacgaccggatggtctccggcgcttatcgacaagaattcggagaatcaaaagaaatcactagcgccatcaagcgtgtccacaagttcatggagagagagggtcgcagaccaagactgctggtggcgaaaatggggcaggacggacatgatcggggagccaaagtaattgctactggttttgcagatcttggctttgatgtggatattggtccattatttcagactccccgcgaagtagctcagcaggcagtcgatgctgatgtgcacgcagtgggaatcagtaccttggccgcagggcacaagaccctagtgcccgaactaatcaaggagctgaattccctcggaagaccggacattttagtaatgtgcggcggcgtcatacccccacaggactacgagtttctgtttgaggtaggagtgtctaacgtatttggccctgggactaggatccctaaagctgctgtgcaggtgttggacgatatcgaaaaatgtctcgaaaagaagcagcagtccgtt

SEQ ID NO: 107 - DNA, 2250 bp, Artificial Sequence
  Codon optimized sequence that encodes an MCM polypeptide with the WT mutation
atgctccgcgccaagaatcaactcttcctgctgtcccctcattatctgagacaagttaaagagagttccggcagtcgcttaattcagcagagactgctccatcagcagcagcctcttcacccagaatgggccgcactggctaagaagcaacttaagggaaaaaacccggaggaccttatttggcacacacccgaaggtatatctatcaagccactgtacagcaaaagagatacgatggacctgccagaggagctccccggggtcaaaccgttcaccagagggccctaccctaccatgtacacctttcgtccgtggacaattaggcaatacgccggtttcagcacagtggaggagagcaacaagttctataaagataatattaaagccggacagcaggggcttagtgtggcctttgacttagccactcatcgggggtacgactccgacaatcccagggtgcggggcgacgtgggcatggccggagtcgcaatagatacagtcgaagacactaagattctcttcgacggcattcctcttgaaaaaatgtccgttagtatgaccatgaacggtgccgttatcccagtcctcgccaacttcatcgtgacaggagaggagcagggagtgccaaaagagaaactgactgggactatccagaatgacatactaaaagagtttatggttcgaaatacgtatatcttccctccggaacccagcatgaagatcattgcagacatctttgagtatactgcaaaacacatgcctaaatttaactccatctcaataagcggatatcacatgcaagaagcgggtgccgatgccatccttgagttagcttacacattggcggatggacttgaatactcccgtactgggctccaggcagggctaaccattgatgagtttgctccacgcctctcctttttctggggtataggcatgaatttctacatggagatagccaagatgcgtgctggcagacggttatgggcccaccttatagagaaaatgttccagccaaagaactccaaatcacttctgctccgtgcccattgccagacatctggttggtcactgactgagcaggatccatacaataatatcgtgcgcacagcaatcgaggctatggcggcagtgttcggcggcacacagtcactccataccaattctttcgacgaggcactcgggcttccgactgtaaagtctgccagaattgcccgtaacacacagatcattatccaggaagagagcggaatccccaaagtcgctgacccctggggcggttcctatatgatggaatgtctgaccaacgacgtgtacgacgctgccctgaagctcatcaatgagatcgaagaaatgggaggtatggctaaagccgtcgcagagggcattcctaagctgcgcattgaggaatgtgccgcacggaggcaggccagaatcgactcaggaagcgaagttatcgtgggagtgaataagtaccagctagaaaaggaggatgcagtcgaggttctcgctatcgacaataccagcgtgaggaataggcagattgagaaattaaaaaagattaaatcatcaagggaccaagcccttgccgagagatgtctggctgcgttgacagagtgtgcggcctcgggtgacgggaacattctggcgctggccgtggatgcatccagggctcgctgcactgtgggggaaattactgatgctctcaagaaggtattcggagaacataaggccaatgataggatggtgtccggggcctaccgccaagaattcggggagagcaaagaaatcaccagcgccataaagcgcgtgcacaaattcatggagagggaaggaagaagacctaggctcctggttgccaagatggggcaggatggacacgaccggggagccaaggtcatagccactggattcgccgacctcggcttcgatgtcgacatcgggcccctgttccagactcccagagaagtggcgcaacaggccgtcgacgcggacgtacacgcagtgggtatatcaacactggcggccggccacaagaccctagtgccagagcttattaaagagctgaattctctgggccgtccagatattctcgtgatgtgtggaggagtgatacctccacaggactatgaatttctgttcgaagtgggcgtgagcaatgtttttggcccggggacccggatcccaaaagcagctgtgcaagtgcttgacgacatagagaaatgtctcgagaaaaaacagcagtcagtc

SEQ ID NO: 108 - DNA, 2250 bp, Artificial Sequence
  Codon optimized sequence that encodes an MCM polypeptide with the WT mutation
atgctcagggctaagaatcagctgttcctgctgagcccccactacctgaggcaggtcaaggagagctccgggtctagactcatacagcagcgactcctgcaccaacagcaaccgctccatcctgagtgggcggccttagccaaaaaacaactgaaagggaaaaatcctgaggatctgatttggcacactcccgagggaatctcaattaagccactctatagcaaacgggacacaatggatttgcccgaagagctcccgggagttaagccattcacccgcggcccttaccctaccatgtacacatttcggccctggactataagacaatatgcagggtttagtactgtagaagaatccaataagttctataaagataacatcaaggctgggcagcaaggactctctgtagctttcgacctagctacccacagaggatatgatagcgataacccaagagtgcgaggggacgttggaatggcaggcgtggctatagacaccgtagaagatacaaagattctgtttgacggcataccactggagaagatgagcgtgtccatgaccatgaatggggcggtgatacccgtgctcgccaattttatagtaacaggcgaagaacaaggcgtgcccaaagaaaagctgacaggtacaatccagaacgacattcttaaagaattcatggttcgaaacacctacatttttccccctgagcccagcatgaagataatcgctgatatctttgaatacacagccaagcacatgcctaagtttaacagtatctccatcagcggctaccacatgcaggaggccggtgcagacgctatcctggagctggcctacactttggccgatgggctggaatatagccgtactggactgcaggcagggcttacaatcgacgagttcgcacccaggttaagcttcttctggggcattggtatgaatttttatatggaaattgctaagatgagggcaggccgcaggctgtgggcccacttgattgagaagatgttccagccaaaaaacagcaaatccttgttactgagggcacattgtcagacatccggatggtccttaaccgagcaggatccctacaataacatagtgagaacggccatagaagcaatggccgctgtcttcggaggcacccaatccctacacacaaactctttcgatgaagcactgggactccccacagtgaagagcgctagaattgctcgcaatacccaaataatcatccaggaggagagtggcattcccaaagtcgcagacccgtggggaggctcgtacatgatggagtgtctcaccaatgatgtctatgacgctgcattgaagctgataaatgaaatcgaagagatgggggggatggcaaaagctgttgccgaaggcatccctaagctgaggattgaggaatgcgccgcgcgccgccaggcccgtatagacagtgggtccgaggttatcgttggggtgaataagtatcagttggaaaaagaagatgctgttgaggtgcttgcaattgacaacacctccgtgcgaaatagacagattgagaaattgaagaaaatcaaatcttctcgggaccaagccctggccgagcgatgtctggctgcgctgaccgaatgtgcggcctccggcgacggcaacattctggccttggctgtggatgcatcgcgcgctcgctgtacggtgggagagattactgacgcactcaagaaggtctttggagaacacaaggccaatgatcgaatggtttccggcgcataccgacaggaattcggtgagtccaaggagataactagcgccataaaacgggtgcataagttcatggaaagagaagggcgaaggcctagactgcttgttgctaaaatgggacaagatggtcatgatcggggagctaaagttatcgcgactggatttgccgatctcggatttgacgtggacataggccccttattccagaccccccgtgaggtcgctcagcaggccgtggacgctgacgtgcatgccgtcggtatctcaacccttgccgccgggcataagactctggtgcccgaactcattaaagaactgaactccctgggccgccccgacatccttgtcatgtgcggcggcgtcatcccaccccaggattacgaatttctcttcgaagtgggtgtgagcaacgtctttggccctgggaccagaattccaaaggcagcggtccaggtcctggatgacatcgaaaagtgtctcgagaagaagcagcaaagcgtg

SEQ ID NO: 109 - DNA, 2250 bp, Artificial Sequence
  Codon optimized sequence that encodes an MCM polypeptide with the WT mutation
atgctcagggccaaaaaccaactgttcctccttagcccgcactatctgaggcaagtcaaagagagcagcggatcacgactaatccagcagaggctgttacaccaacagcagcccctacatcccgaatgggcagcactcgctaagaagcagttgaagggtaaaaaccctgaagatctgatttggcacactccagaggggatttcaatcaaacctttgtattctaagagggataccatggatctgcctgaggaactgcctggcgttaaacctttcacccgaggaccgtatcccacaatgtataccttccggccctggactatcaggcaatacgcagggttctctaccgtggaggagtctaacaaattctataaggataatataaaggctggccagcaggggctgtcagtagcatttgatctggccacacaccgtgggtacgactcagacaaccccagagtcaggggggacgtcgggatggcgggcgtggctatagatactgtagaggacacgaaaattttattcgacggtattccactggaaaagatgagtgtgtctatgacaatgaacggcgctgtgatcccagtgctcgccaactttattgtcaccggggaagagcagggagtgcccaaagagaaactgaccggcaccatccagaatgatatcctgaaagaattcatggtccgaaacacatacatctttccgcctgaaccctctatgaagatcattgctgacatattcgaatacaccgccaaacacatgcccaagttcaatagcatttccatttcaggataccacatgcaggaggctggagccgatgctattcttgagttggcttacacactcgccgacgggctggagtattcccgtacagggcttcaggccggacttaccattgacgagtttgcgccaagattatcatttttttggggaattggtatgaatttctacatggagattgccaaaatgcgggcagggaggcggctctgggcccacctgattgaaaagatgtttcagcctaaaaactcaaaatctctgttactgagggcccattgtcagacctccggatggagcttaactgagcaggacccatacaacaatatcgtacgaaccgcaatagaggccatggccgccgtgttcggcggcacccaaagcctgcacaccaatagcttcgatgaggccctaggcctaccgacagtgaaaagcgcaaggattgcgcgtaacacgcagattattattcaggaggagagtggcatacccaaagttgccgacccttggggaggctcgtacatgatggagtgcttgactaatgatgtatacgatgcagcactcaagttaatcaacgagatagaagagatggggggaatggccaaggccgtggcggagggtattcccaagctccgtatcgaggagtgtgctgcccgtcgccaagcccgtatcgatagtggatctgaagttatagtgggcgtcaacaagtatcagttggagaaggaggacgctgtggaagtgctcgcaatagacaacacctctgtgaggaatcgacagatagagaaactcaagaaaatcaaatctagtagagaccaggcgctcgccgagagatgccttgctgctttaacagaatgcgctgctagcggcgacggaaacatcctagcccttgccgttgacgcctcaagggctcgatgcacagtcggcgagattacggacgccctgaaaaaggtattcggcgagcacaaagccaacgaccggatggtttcaggagcctatcgccaggagttcggagaatccaaagaaataacatccgctattaaaagagtgcacaaatttatggaacgggagggtcgaaggccccgacttctcgtcgcgaagatgggccaggacggccatgatcgcggggcgaaggtaattgccaccggcttcgccgatctcggtttcgatgtcgatatcggacctctgttccagactccgcgagaggtagcccagcaggctgtggatgcagacgtgcatgctgtagggattagtactttagccgcaggccacaaaaccctggttcctgaattaatcaaggagctgaactcccttgggaggccggatatattggttatgtgcggcggagttatacctccccaggactacgagttcctgtttgaggttggtgtatctaacgtctttgggcccggaacacggatccccaaagctgcggtacaggtactcgatgacatcgaaaagtgtttagaaaagaaacagcagagtgtg

SEQ ID NO: 110 - DNA, 2250 bp, Artificial Sequence
  Codon optimized sequence that encodes an MCM polypeptide with the WT mutation
atgctgagggccaagaaccaactgtttctgctcagcccgcactaccttaggcaggtgaaggagagttccgggagtagattaatacagcaacgtttgttgcaccagcaacagccccttcacccggagtgggccgccctggcaaagaaacagctgaagggaaagaaccccgaggatctaatttggcacaccccagagggtatctccattaagccgctctacagcaagcgcgacaccatggacctcccagaagagctgcctggtgtcaagccgtttactagagggccataccccactatgtatacattccggccctggactatcagacagtatgccgggttctcaacagtcgaggaatctaacaagttctataaggacaacataaaagcgggccagcagggacttagcgtagccttcgacctcgctacccaccggggctacgacagcgacaatcccagagtaaggggcgatgttgggatggcaggtgtggccatcgatacagtggaagataccaaaatccttttcgacggaattcccctcgaaaaaatgtccgtcagtatgacaatgaatggcgccgtgattcccgtactggctaatttcattgtgaccggagaggagcagggcgttcccaaggagaagttgactggaacaattcagaatgacattctgaaggagtttatggtgcgcaacacctacatttttcctcctgaaccctctatgaagatcatagctgatatttttgagtacaccgcaaagcacatgcctaagttcaatagcattagtatcagcgggtatcatatgcaggaagccggtgctgacgctatcctggaattagcctacacgctcgcagatggcctcgagtactctcgaaccgggctgcaggcaggcctgacaattgatgagtttgcccctcgattatccttcttttggggcattgggatgaatttctatatggagattgccaagatgcgcgcgggccggaggttatgggcccatttgattgaaaagatgttccagcccaagaattccaagtccctgctgctccgggcacattgccaaacgtccggctggagcctgacggagcaagacccctataacaatatcgtgaggacggcgatagaggccatggctgctgttttcggcggtacgcaatccctgcacacgaactcattcgatgaagcccttgggcttcctactgttaaatccgcgagaattgcaagaaatacccagataataattcaggaagagagcggcatccctaaggtagctgatccttggggcgggtcctacatgatggagtgtctgactaatgacgtctacgatgccgcattgaaattaatcaatgagatcgaggagatgggaggaatggccaaagccgtggccgagggcatccccaagctccggattgaggagtgcgcagcccgacgacaggcccgtatcgattcaggttcagaggtgattgtcggagtaaacaagtaccagcttgagaaagaggatgcagtagaagtcctggcaatagacaatacatcagtgcgcaatagacagattgagaaactcaagaaaattaagtcctcaagggatcaggctctggcagagcggtgcctagcagctcttacggaatgtgccgccagcggcgacggaaacatattggcgctagcggtggatgcaagcagggcaagatgtactgtcggcgagatcactgatgccctgaagaaggtgtttggcgagcacaaggctaatgatcgcatggtctctggagcatacaggcaagaattcggtgaatctaaggaaatcacatccgccataaaaagggtgcacaagtttatggagcgggaaggcaggaggccccgtctgctcgtggctaaaatggggcaggacggccatgacaggggcgcaaaggttattgccactggcttcgcagatttaggatttgacgtggacatcggacccttgttccaaaccccacgagaggtggcacaacaagctgtggacgctgatgtacatgccgtgggaatctccacccttgccgctggacacaaaaccctggtgcccgaactgatcaaggaactaaattcccttggccggccagatatcctggtgatgtgcggcggcgtgataccacctcaggattacgagttcctatttgaagttggggtatctaatgtgttcggtcctggcacacgtattccaaaagccgcggtccaggttctggacgatattgaaaaatgtcttgagaaaaaacagcagtcagtg

SEQ ID NO: 111 - DNA, 2250 bp, Artificial Sequence
  Codon optimized sequence that encodes an MCM polypeptide with the I69V mutation
atgcttcgtgctaaaaaccaactgtttttattgtctccccactacctgcgacaggtaaaagagtccagcggatcccgtctaatccagcaacgtttgttgcatcagcaacagcccctgcaccccgaatgggccgcactggcgaaaaagcaactcaagggcaaaaatccagaggacttaatttggcatacccccgaagggatttccgtgaagcccctctattccaaacgggatacaatggatttgcccgaggaactcccaggtgtgaaaccctttacaaggggcccataccccaccatgtatacattccgaccctggactattaggcagtacgcggggttctctacagttgaagaatcaaacaaattctataaggacaatattaaggccggccagcagggcctgagcgttgcttttgacctcgccacccacaggggctatgatagcgacaaccctcgcgtcaggggggatgtgggcatggccggggtggccatagacaccgtggaggacacgaaaattttgttcgatggaatcccactcgagaagatgtccgtgagtatgaccatgaacggcgctgttatccctgtgctggcaaactttatcgttaccggcgaggaacagggagttccaaaggaaaagctcacaggtaccattcaaaatgatatcttgaaggaattcatggtacgaaacacgtatattttccctcccgagccaagtatgaagatcattgccgacatcttcgagtataccgcgaagcatatgccaaaattcaattctatcagtatttctgggtatcacatgcaggaggctggtgcagacgctatcctcgagctcgcctatactctcgcagatggcctggaatacagccgtactggtcttcaagccggcctcacaattgacgaatttgcccctcggctcagttttttctggggtatcggcatgaatttctatatggagatcgccaaaatgagagctggtaggcgcctgtgggctcatctgatcgaaaaaatgtttcaacctaagaactctaagagcctcctcctgcgggcacactgtcaaacatccggttggagcctgacagaacaagatccctacaataacattgtccggactgccatagaagcgatggccgcggtctttggcggcacacagtctcttcatacaaattcctttgatgaggcactgggactgcccacggtgaagagtgcacggattgcgaggaatactcagataattatccaggaagaatccggtataccaaaagtcgccgatccttggggaggttcctatatgatggaatgtctgactaacgacgtctatgacgccgcactaaagctaataaatgagatagaggagatgggcggtatggcaaaagctgtggccgaggggattcctaaacttcggattgaggagtgtgccgcccgcaggcaagcccggatcgactcagggtcggaggtgatcgtgggcgtaaacaagtatcagctcgaaaaggaggacgccgtagaagtcctcgccattgacaatacctcggtgcgcaaccgccagatcgagaagctaaagaagataaagtcgtccagagaccaggcgctggctgagaggtgcctggctgccttaaccgagtgtgcagcgtccggcgacgggaatatcctggccttggcggtggatgcctctagagcgaggtgtaccgtgggcgagattacagacgccctaaaaaaggtgtttggtgagcacaaggccaatgatagaatggtctcaggggcctatcggcaagaattcggtgagtcaaaggagatcacctctgccatcaaaagagtgcacaaattcatggaaagggagggcaggaggcccagattacttgttgccaagatgggccaggacggccatgaccgtggcgctaaggtgattgctacaggctttgcagatttgggattcgacgtagatattggcccgctctttcagacgcctcgtgaggtggcccagcaggcagtagatgccgatgtccatgccgtagggatcagcactcttgcagccggacataagactttggttccagaattgataaaggagctcaactctctgggccgccctgacatcttggttatgtgtggcggggtaatccccccacaggattacgaatttctcttcgaggtaggagtatcaaatgtcttcgggccaggaacccgcatcccaaaagctgccgtgcaggtcctcgacgacatcgaaaaatgcttggagaaaaaacaacagagcgtg

SEQ ID NO: 112 - DNA, 2250 bp, Artificial Sequence
  Codon optimized sequence that encodes an MCM polypeptide with the I69V mutation
atgcttcgggcaaagaatcagttgttcctgttgtctccccactacttgagacaggttaaagaatcctctggctcacgcctcatccagcagaggctgcttcaccaacagcagcctctgcaccctgagtgggcagccctggctaaaaaacagctaaaaggaaagaatcctgaggatctgatctggcacacccctgaggggatttcagttaaaccactgtactccaagagggacacgatggatctgcccgaggaacttccgggggtgaagccgttcacccgcggcccataccctactatgtacacattccggccgtggacaattcggcagtatgcaggattttctacagtagaggaaagcaataagttctacaaagataatattaaggctggtcagcagggtctgtcagttgccttcgacctggcaacccacaggggatacgactccgataatccgcgggttcgtggggatgtcggcatggctggcgtcgccatcgatacagttgaggacaccaaaattctgtttgatggaatcccccttgaaaaaatgtcagtgtccatgaccatgaatggggccgtgattcctgtcctggccaattttatcgtgaccggcgaagagcaaggagtgccaaaggaaaaactgaccggtacgatccagaatgacatattgaaagaattcatggtccgcaacacgtatattttcccacccgaaccttctatgaagatcatcgcggatatctttgagtacacagctaaacacatgccaaagttcaacagtatctcaatcagcggataccacatgcaagaggccggcgctgatgcaattctggagctggcctacactcttgccgacggactggaatacagccggacggggctccaggctggtcttacaatcgatgaattcgcaccccggcttagtttcttttgggggatcggcatgaacttttacatggagattgccaaaatgagggctggtcggcgcctctgggcacatcttattgagaagatgtttcagcccaaaaactctaagagtttactgcttagggcccattgtcaaacaagcgggtggagtctgacagagcaggacccttataataacatcgttaggaccgccattgaagcgatggcggcagtatttggaggcacccagagcctgcacactaacagtttcgatgaagcacttggcctgcctacagtcaagagcgctcgaatcgctcgtaacacccagataatcattcaggaggagagtggcatacccaaagtggccgatccctggggcggatcttacatgatggagtgtttaaccaacgatgtatatgacgccgccttaaaactaattaatgaaattgaagaaatgggaggaatggcaaaggcggtggctgaaggcatccccaagcttcggatcgaggagtgtgccgctagacggcaggcacgtattgactcaggaagtgaagtaattgtgggagtgaacaaatatcagttggaaaaagaagacgccgtggaagtgctcgccattgacaacacctccgtgcggaaccgtcagatcgaaaagctgaagaagattaagtctagccgggaccaggctctcgcagaaaggtgtctggccgcccttaccgaatgcgccgcgagtggcgacggcaacattctggcactggccgtcgacgcatctcgggctcgctgcaccgtaggagaaatcacggacgctctgaagaaggtgttcggagaacacaaggctaacgaccggatggtctccggcgcttataggcaggagtttggggaatccaaagaaattaccagtgccataaaacgggtccacaaattcatggagagggagggccggcggcctcggcttctcgtggccaaaatggggcaggacggacacgatcgaggtgcaaaggtcatagcaactggtttcgccgacctgggattcgatgttgatatcggacctttatttcagactcctcgcgaagtggctcaacaggccgtcgacgctgacgtgcacgccgtggggatctcaactctagcagcaggccataaaactctggttccggaactcattaaagaactcaattcgctggggcggccagacatcctggttatgtgcggaggtgttatccccccccaagattacgagttcctgttcgaggtcggcgtcagcaatgtgttcgggccaggtacgaggatccctaaagccgctgtacaggttctggatgatattgagaaatgtcttgagaaaaaacagcaatccgtc

SEQ ID NO: 113 - DNA, 2250 bp, Artificial Sequence
  Codon optimized sequence that encodes an MCM polypeptide with the I69V mutation
atgctaagggcaaagaatcagctcttcctgctatcacctcactatctcagacaggtgaaagaatcttctgggtccaggctcatacaacagagattgcttcatcaacaacaaccgctgcatcctgagtgggctgctctggctaaaaagcagttgaagggcaaaaaccccgaggacctcatctggcatacaccagaaggcatttcagtcaagcccctctatagtaagagggatactatggatctgcccgaggagctgcccggtgtaaaaccgtttacacggggcccatacccaaccatgtataccttcaggccttggacaatccgtcagtatgctggcttctccacggttgaggaatctaacaagttttacaaggataacatcaaagctggacagcagggtctgagtgtggcattcgacttagcaacacatcggggatacgacagtgacaatccccgggtgagaggcgacgtgggcatggcgggagtggctattgatacagtcgaagatactaaaatcttgtttgatgggattcccctggagaagatgagcgtgtcgatgaccatgaacggggctgttatccctgtgcttgcaaactttatagtaacaggggaggaacagggcgtgcctaaggagaagttgaccggcaccatccagaacgatattcttaaggagttcatggtgaggaatacatatatcttccctccagagccaagtatgaagatcatagccgatatttttgaatataccgccaagcacatgcccaaattcaattctatctcaatttcaggctatcatatgcaggaggccggagcagacgctattctggagcttgcatacacactcgcagatggcctcgaatactcccgaaccggactccaggcaggccttacgatcgacgagttcgctccgcgattatccttcttctgggggatcggcatgaacttttatatggaaattgccaagatgagagccggaaggaggctgtgggcacacctcatagagaaaatgtttcagccgaaaaatagcaagagcttgctgcttagagcacattgccaaacctcaggctggagcctgaccgaacaggacccatataacaatatcgtgcgcaccgccatcgaagcaatggcagctgtgtttggcggcacccaaagccttcataccaattcatttgacgaggctctgggcctgcccaccgtcaagagcgcccgtattgcccgcaacacacagatcattattcaagaggagagtggcatacccaaggtggcggacccctggggcgggtcgtatatgatggagtgcctgaccaacgacgtctatgacgccgcgctgaagcttattaacgagatcgaagagatgggcgggatggccaaagccgtagcagagggcattccaaaacttcgaatcgaggaatgtgcagccaggcgacaggcacgcatcgactccggctcagaggtcatcgtcggcgtcaataaataccaactagaaaaggaagacgcagtggaggtgctggcgattgacaataccagcgtccgcaatagacagatcgagaagctcaagaaaattaaaagttccagggatcaggcgctcgcagagcggtgtcttgctgccctaaccgaatgtgccgcttcgggggatggcaatattctggcattggccgtggacgccagtagagcacggtgtaccgttggagagattacagacgccttaaaaaaggtcttcggcgagcataaagctaacgacaggatggtctccggcgcttaccggcaggaatttggcgagagtaaagagattaccagcgccattaagcgcgtacataagttcatggaaagagaagggcggcggcctcgactcctggtggccaaaatgggacaggacggtcatgaccggggtgctaaagtcattgcaacgggtttcgcagacctcggttttgatgttgacatcgggccgctcttccagacacccagagaagtagctcagcaggcagttgatgcggatgtacatgcggtgggcatcagtacgctggcggcaggccacaagaccctggtgccagaattaatcaaggagctcaatagtctgggtcgcccagacattctggtaatgtgcgggggagtaatcccaccccaagattacgaattcctgttcgaggtcggcgtcagcaacgtctttggtccagggactcgcatccctaaagccgctgtgcaggtgctggatgacatcgaaaaatgcctagagaaaaagcagcaatccgtg

SEQ ID NO: 114 - DNA, 2250 bp, Artificial Sequence
  Codon optimized sequence that encodes an MCM polypeptide with the I69V mutation
atgctgcgcgccaagaatcagttgtttctgctgagcccacactatttgcgtcaagttaaggagtccagcgggtcccggctgatacagcagaggctgctgcaccagcagcagcccttgcacccagaatgggccgctttggccaagaaacagctgaaagggaaaaaccccgaagacctcatttggcataccccagaagggatttctgtcaaaccactctattcaaagagggacaccatggatctgcctgaggagctgcctggcgtgaaacctttcacaagaggcccatacccaaccatgtatacattcaggccatggaccatccgccagtatgctggtttctccaccgtagaagagtccaataagttttataaggataatataaaagcaggacaacagggactgtcagtcgccttcgatctggccacgcatagggggtacgacagtgataacccacgggtgcggggtgacgtcggaatggctggagtggccatcgacaccgttgaggatacaaaaatcctgtttgatggtatccctctcgaaaaaatgagcgtgtcaatgacgatgaatggcgctgtcatcccagttttggccaactttattgtgacgggtgaggagcagggtgtgcccaaggagaaactcaccggcacaatccagaatgatattttgaaggaatttatggtaagaaacacttatatcttcccacccgagccgagcatgaaaattatcgccgacatttttgagtacacagccaagcacatgcctaaattcaatagcatctcgatctctggatatcacatgcaggaagccggcgctgatgccatactcgagctcgcctacacacttgccgacggactcgagtacagccgaactggccttcaggccggtctgactatcgacgaattcgctcctagactgtcgttcttttggggcattgggatgaatttctatatggagatcgccaaaatgcgggccggacgcagactctgggctcatctcattgagaagatgtttcaacccaaaaattcaaaatcccttctcctgagggcccattgccagacaagcggctggtccctcacagagcaggacccttataacaatatcgttagaaccgccattgaagccatggccgctgtgtttggaggcactcaatctttacatacaaattcctttgacgaggctttagggttgcctaccgtcaaatccgccagaattgccaggaacacacagattattatccaagaagagtccggaatccccaaagtggctgacccctggggtggtagttatatgatggaatgtttgactaacgatgtatacgatgccgccctgaaactgatcaatgagatcgaggagatgggcggtatggcaaaggccgtcgccgaaggcattccaaagctgcggatagaggagtgcgctgcccgtagacaggcccgaatagacagcggctctgaggtaatcgtgggggtcaacaagtaccagttggaaaaggaggacgctgtcgaggttctggccattgacaacaccagcgtccggaaccgccagattgagaagctgaagaagattaagagttcccgggaccaggccttagccgagcggtgtttggcagccctcacagaatgtgctgcctcgggcgacggcaatattctggccctcgctgtcgatgcatccagggcacgctgcacagtgggggaaattacagatgcactgaagaaggtattcggcgagcataaggccaatgaccgtatggtcagtggggcctataggcaagaatttggtgagtccaaggagattacatcagccataaagagagttcataagtttatggagagagaggggcggcggccacgtcttctggttgctaaaatggggcaagatggacacgatcgtggggccaaagtgatcgcaaccggcttcgctgacctggggttcgacgtggatatcggccctctgttccagactccccgcgaagtggctcagcaagctgtggatgcagatgttcacgctgttgggatttcaacactggccgccggacacaagacgttggtgcccgagctgattaaagaactgaactcactgggaagacccgacatcctggtgatgtgcgggggggtcatccccccgcaggactatgagttcctgtttgaggttggcgttagcaatgtttttggccctggcactcgtattccaaaagctgctgtgcaggtgcttgacgatatcgagaagtgccttgagaagaaacagcagagtgtg

SEQ ID NO: 115 - DNA, 2250 bp, Artificial Sequence
  Codon optimized sequence that encodes an MCM polypeptide with the I69V mutation
atgctcagggccaagaaccaactgtttcttctgtctcctcactatctgcgccaagtaaaggagtccagcggaagtcgcttgatccagcaacggttattgcatcagcagcagcccttacaccccgaatgggccgccctggccaagaagcaactgaagggcaagaaccctgaagatcttatctggcacacccctgaaggcatttcggttaaacccctgtatagcaaacgggataccatggatttgccagaagaacttcccggcgtgaagcccttcacccgcggcccataccctactatgtatactttccggccatggacaattaggcaatacgcgggcttttccactgtagaggaatctaataagttctacaaggacaatatcaaggctggccagcaaggactcagcgtagcattcgacttggccacgcatagaggctatgacagcgacaatccccgcgtaaggggagacgtggggatggccggagtggccatcgacaccgtggaggatacgaagatcctgtttgacggaatcccattggaaaaaatgagcgtgtctatgaccatgaacggcgccgttatccccgtcctcgcaaattttatcgtgacgggggaggagcagggggtgcccaaagagaagctgaccggaactattcagaacgatattctgaaggagttcatggtcagaaacacttacattttccctcctgagccatcaatgaaaatcatcgccgatatctttgaatacacagcgaaacatatgcctaagttcaatagcatctctattagtggctaccacatgcaggaagctggagccgatgctatcctggaattagcttacacgttggcagatgggctcgaatacagccgcaccggccttcaggctgggctcactatcgatgagtttgcgccacgcctgtcatttttttggggtattgggatgaatttttacatggaaatcgcaaagatgagagccggccggagattgtgggcccatctgattgagaagatgttccaacccaagaattccaagtccttgttattacgcgcacattgtcagaccagtggttggagtctcactgagcaggatccttataataatatcgtgcgcaccgctattgaggctatggcggccgtttttggtgggacccagagtctacacacaaatagctttgacgaggccttaggacttccgaccgtgaagtcagcgcgcatagcccgcaacacgcagatcattattcaagaggaatccgggatccctaaagtcgccgacccctggggcggatcatacatgatggaatgtctgacgaacgatgtgtatgacgccgccctcaagcttatcaacgagatcgaggagatgggtggtatggcaaaagccgtggccgaagggatccctaagctcaggattgaggagtgtgcagccagacgccaggcccgcatcgactcaggtagtgaggtgatcgtcggggtgaacaagtaccagctcgaaaaggaggacgccgttgaggtcctcgctattgacaacacctccgtcaggaataggcaaattgagaaattaaagaagattaagtcctcccgggaccaagccttagccgaaagatgtctggcagctctgaccgagtgcgcggcaagcggcgacggcaacatactggctctggctgtggacgcctccagggcacgttgtaccgttggcgaaatcaccgatgcactgaaaaaagtgtttggggaacataaagccaacgacaggatggtatccggagcttatcgccaggaatttggagagtctaaggagattacgtcggcaatcaagcgagtgcacaagttcatggagcgggagggcaggagaccgaggttattggtggctaagatgggacaggacggccacgatcgcggagctaaagtgatcgctaccggatttgcagacctgggtttcgacgtagatattggtcccctgtttcaaaccccaagggaggtcgctcaacaggccgtcgatgctgatgtgcacgctgtgggcatcagcaccttggctgctggacacaaaactcttgtgcccgaactgatcaaggagcttaattcactgggaaggcccgacatcctggtgatgtgcggaggagtgatcccacctcaggattacgagttcctctttgaggttggggtgtctaatgtgttcggtcccgggacccgtatcccaaaagcggctgtccaggtccttgacgatatcgagaaatgcctagagaagaaacaacagagcgtc

SEQ ID NO: 116 - DNA, 2250 bp, Artificial Sequence
  Codon optimized sequence that encodes an MCM polypeptide with the I69V mutation
atgctacgggccaaaaatcagctgttcctgctcagtccccactatctgcgccaggtgaaggagtctagcggctcaaggctgatacagcaacggctcctgcatcagcaacagcctctgcaccccgaatgggcagcccttgccaaaaaacaactcaagggcaagaatccagaggatttgatttggcacacgcctgaagggatcagcgtaaagccgctttactctaaacgcgacactatggacctgccagaagaactgccgggagtgaagcccttcacgcggggtccataccccaccatgtacacctttcggccatggactattagacagtacgccgggttcagtaccgtggaggagtctaataagttttacaaggataatatcaaggctggacagcagggtttgagcgtggcctttgaccttgcaacccaccgggggtacgacagcgacaacccccgggtgaggggggacgtaggtatggccggggtggcaattgacaccgtagaagatactaagattttgttcgatggaattcctttggagaaaatgagtgtgtctatgaccatgaacggagcagtgatacccgttctagccaattttattgtgaccggggaggagcaaggtgtgcctaaagagaaactgactggcacaattcagaacgatatcctgaaggagttcatggttagaaacacatatatatttcccccagaaccgagtatgaagattatagccgatatcttcgaatatacagcaaaacacatgcctaaatttaatagcatctcaatctccggttatcatatgcaggaagcaggagccgatgcgatactggagttagcttacacgctcgccgacggcttagaatattcaagaactgggttacaggcagggctaacaatcgatgagtttgccccaagactgtccttcttttggggaatcggaatgaacttttacatggaaattgccaaaatgagggccggaagacggctttgggcacatttgatcgagaagatgtttcagcccaagaactccaagagtctcttgctgcgagcgcactgtcaaacttccggttggagcctcaccgagcaagacccgtataacaacatcgtcaggactgcaattgaagccatggctgcagttttcggtgggacacaatctctgcacaccaattcctttgacgaagcactggggcttccgaccgtgaagtcagctcggatcgctagaaatacccagataattatccaggaagaaagtggcatccctaaggtggctgatccttggggcgggagttatatgatggagtgtcttacaaatgatgtctacgacgcggcgcttaagctgatcaacgaaattgaggaaatgggaggaatggcaaaggccgtcgctgaaggcatacccaagttgaggatcgaggaatgtgctgcccgcaggcaagccagaattgacagcgggtcagaggtgatagtcggcgtgaacaagtaccagctcgaaaaagaagatgctgtcgaagttttggcaatagataatacttccgtaaggaaccgccagatagaaaagctcaaaaagattaagagttcaagggaccaggcattagcagagaggtgcctggcagccctgactgagtgtgccgcgtcaggggacgggaatatactggccctggctgttgacgcaagtagagcccgctgtaccgtgggagaaatcacagacgcccttaaaaaggttttcggtgaacacaaggccaacgatcggatggtgtccggcgcctaccggcaggaatttggcgaatctaaggaaatcacctcagccattaagcgcgttcacaagtttatggaaagggaagggcggagaccaaggctgctggtggccaaaatggggcaggacggacacgatagaggcgcaaaagtgattgcaaccggctttgccgatttaggcttcgacgtcgacatcgggccactgtttcaaactccccgagaagtggcccaacaggcagttgatgctgatgttcatgccgttggcatttctaccctggccgcaggacacaaaaccctcgtccccgagttgatcaaagaattaaacagtctggggagacctgatatactggtcatgtgcgggggagtgattcccccccaggactacgaattcttattcgaggtgggtgtgagcaatgtcttcggaccagggacacggatacccaaggccgccgttcaggtgctggacgacatcgagaaatgtttggaaaaaaaacagcagtccgtt

SEQ ID NO: 117 - DNA, 2250 bp, Artificial Sequence
  Codon optimized sequence that encodes an MCM polypeptide with the I69V mutation
atgctgcgcgctaaaaaccagctgttcttgttgtcacctcactacctccgacaggtgaaagaatccagcggttccaggctgatccagcagcgtctgctgcatcaacaacagccccttcaccctgagtgggctgccttagctaagaagcagttaaagggaaaaaacccagaggatctcatctggcacaccccagagggcatctctgtgaagcccttatacagcaagagagataccatggacctacccgaggagcttcccggagttaagccctttactcgaggtccttatcctactatgtacactttcaggccatggacgatcaggcagtacgccggcttttccaccgtggaagagtcaaataaattttacaaggacaacatcaaggctggccaacagggactctcagtagctttcgacctcgccacccaccgcggatatgacagtgacaatccacgcgtgagaggcgacgtcggaatggccggagtcgctatcgacacagtggaggatactaaaatcctctttgacggaatccctctcgaaaaaatgtctgtgtccatgacgatgaatggcgcagtgatcccagtgttggctaatttcatagtgaccggcgaagagcaaggtgtgccaaaagagaagctgaccgggacaattcagaacgatatactcaaggaatttatggttcgtaacacttatatattcccgcccgagccatccatgaagattattgctgacatctttgagtacacagctaagcacatgcctaaatttaacagtatcagtatctctggctatcacatgcaggaggcgggggcagatgcaattcttgaactggcctacaccttagcggatgggttagaatacagcaggaccgggttgcaggccgggcttacaatcgacgagttcgcccctcgcctgagcttcttctggggcattggaatgaacttttatatggagatagctaagatgcgggccgggcgtcgactctgggctcacctcatcgaaaagatgtttcagcccaagaattcaaaaagccttctgctgagagctcactgccagacatccggttggtcccttaccgagcaagacccatacaataacatcgtgcgcaccgcaatcgaagctatggccgccgtttttgggggcacgcagtccttacacacaaattcatttgacgaggcgctcggtctccccacggtgaaatccgcgaggattgcgcggaatactcaaatcattattcaggaggagagtggaatcccgaaggttgcggatccatggggcggttcatatatgatggagtgccttacaaatgatgtgtatgacgcagcacttaaattgattaacgagatcgaggaaatgggcgggatggccaaggctgtggccgaaggcatcccaaaactgcggatcgaggaatgtgctgctagaaggcaggctcggatcgactcaggaagcgaagtcatcgtgggcgtcaacaaataccagctagaaaaagaagacgccgtggaggtgctcgccatcgacaataccagtgtaagaaatcgccagatcgaaaagcttaaaaaaattaagtcctcccgggaccaggcgttggccgaacgctgccttgccgctctgaccgagtgtgccgcatccggcgatggaaacatactcgcactcgcagtcgacgccagccgggctagatgtaccgtaggcgagattacagatgccctgaagaaagtgttcggggagcacaaggccaacgatcggatggtgagcggcgcatatagacaggagttcggggagagcaaggaaatcaccagcgccatcaaaagggtgcacaaattcatggagagagaaggacggcgaccccggttactggtagctaaaatgggtcaggatggccacgaccgaggggccaaggtgatcgccaccggatttgccgacttggggtttgacgtggacattggacccctatttcaaactccgagagaggtcgcacagcaagctgtagatgccgacgtgcatgccgttgggatctctacacttgcggcaggacacaagacgttggttccggagcttattaaggagctgaattcactgggcagaccagatattttggtcatgtgcggtggggtgatacccccccaggactacgagttcttgttcgaggtcggagtgtccaacgtgtttggacctggcacacgcatacccaaggcagctgtgcaggtgctggatgacattgagaagtgcctggagaagaagcagcagtccgtg

SEQ ID NO: 118 - DNA, 2250 bp, Artificial Sequence
  Codon optimized sequence that encodes an MCM polypeptide with the I69V mutation
atgctgcgagccaagaatcagctctttttactttcacctcattatctgcgtcaggttaaggaaagctcaggctctagactgattcagcaaaggttactccaccagcaacaacccctgcatccggagtgggccgcactggctaagaagcagttgaagggcaagaatccggaagacctcatctggcacaccccagaggggatatctgtgaagccgctttattctaaacgggacactatggatctgccagaagagctgcctggcgttaagccattcacccgcggaccctatcccaccatgtacacctttagaccatggacaatccgacagtatgcgggcttcagcacagtggaagagtctaataaattctacaaagataacataaaggccggccagcagggcctctccgtcgcgtttgatttagctacacatagaggctacgattcagacaacccaagagtgcgaggcgacgttggaatggctggggttgctattgatactgtagaggatacaaagattctctttgacggtataccgttggagaaaatgtctgtctccatgactatgaatggggccgtgatcccagtcctggccaacttcatagtgacaggcgaggaacagggcgttccaaaggaaaagctgactggaacaatccaaaacgatattctgaaagagttcatggtccggaacacttatattttcccacccgaaccctcaatgaagatcatcgcagatatattcgaatatactgcaaaacacatgcccaaatttaattccatctctatcagtggataccacatgcaggaggccggcgcggacgctatactggagttagcctacacgctcgccgacggcctggagtatagccggaccggtctccaggctggtctgactattgatgagttcgccccacggctgtcctttttttggggcattgggatgaacttctacatggaaatcgcaaagatgcgagcaggaaggcgtctgtgggcccacttaattgagaagatgttccagcccaagaattcaaagtcacttcttctgcgggcacactgccagacgtccggctggtccctgacagagcaggatccttacaacaatatcgttagaacagctattgaggctatggctgctgtgttcggaggcacccagtctctgcacactaactcctttgatgaggcactgggacttccgactgttaagtccgccagaatagcgaggaatacccagattatcatccaagaagaaagtggtatccctaaagtggcggacccatggggggggtcttacatgatggaatgtttaaccaatgacgtgtatgatgccgccttgaagctaatcaatgagattgaggagatgggaggcatggccaaggctgtggcagaaggaattcccaagctccggatagaggagtgtgccgctagaagacaagcccgaatagatagcgggtctgaagtcattgtaggggtgaacaaataccagttggagaaagaggacgcagtggaggtactcgccatcgataatactagcgtccggaaccgacaaattgaaaagctcaagaagatcaaatctagtagggaccaggccctcgcggaacggtgtctggcagcactgacagagtgcgccgccagtggagacggtaatatcctggctctggcggtcgacgcaagtagggctcggtgcactgtgggcgaaattaccgacgcgcttaaaaaggtgttcggggagcacaaagctaacgatagaatggtgagcggagcatatcgtcaagaattcggcgaatcaaaggaaattacttctgcaattaaaagagtacataagtttatggagagggaaggacgccgccccagactgctggtggccaaaatgggacaagatggacacgatcgaggtgccaaagtcattgccacaggatttgcggacctaggattcgacgtggatattggcccactgttccagacgccgagggaagtggcccaacaggcagtagacgccgatgtacatgccgtgggaataagcaccctggctgctggccataaaactctggtgcctgagctaatcaaagagctgaactctttgggacgaccggatatattagtcatgtgtgggggtgtcattcctccccaggactacgagttcctcttcgaggtaggggtgtctaacgtctttggccccggcactcgtattcctaaggcagccgtacaggtgctcgacgatatcgagaagtgcttggagaagaaacagcagtctgtg

SEQ ID NO: 119 - DNA, 2250 bp, Artificial Sequence
  Codon optimized sequence that encodes an MCM polypeptide with the I69V mutation
atgttgcgggctaagaaccagctgttcctcctcagccctcattacttgcgtcaggtcaaggaatctagcgggtcgcgccttattcagcagagactgcttcaccaacagcagcccttgcatccggaatgggccgccctcgcgaaaaaacaactgaagggcaaaaaccccgaggacttaatctggcacacccctgaaggcatctccgtgaaaccactctattcaaaacgagacacaatggacttgccggaggagctcccgggcgtgaagccattcactaggggaccatatccaacgatgtacacgttcagaccctggacgatccggcagtatgcaggtttctccacagtcgaggagtcaaacaaattttataaggataacataaaggccggtcagcaggggctcagcgtggcttttgacctggctacccataggggatacgactccgataatccacgcgtccgtggcgacgtgggcatggccggagttgccatcgatacagtcgaggacaccaaaatactctttgacggaatcccgctggaaaagatgtccgtttctatgactatgaatggggcggttattccagtgctcgcaaatttcattgtaactggtgaggaacaaggagtgcctaaggagaaactaactggcactatacaaaacgacatcctgaaggagtttatggtgcgaaacacatacatctttcctccagaaccctccatgaagattatcgccgatatttttgagtacactgcgaagcatatgccgaagtttaactccatctccatcagtggttaccacatgcaggaggccggagccgacgctatccttgagctcgcctacacgctggctgacggcctggagtacagccgcactggtctccaggctggattaacgattgacgaatttgctccacggctgtcttttttttgggggatcgggatgaacttctacatggaaatcgctaagatgcgggctgggcgccggctctgggctcatctaatagagaaaatgttccaacctaagaattcgaaatctctccttctccgggcacactgtcagacaagcggatggagcctgaccgaacaggacccttacaacaacatcgtccgtactgcaattgaggctatggccgctgtgttcggtgggactcagtcgttacatacaaattcctttgatgaggccctcggactccccaccgtgaagagcgctcggatcgctcgcaatactcaaattattatacaggaagagagcggtatcccaaaagttgccgatccatggggggggagttatatgatggaatgcttaacaaacgatgtgtacgatgctgctcttaagctgatcaacgaaatcgaggagatgggcgggatggcaaaagcagtagccgagggaattccaaaactacgcattgaggagtgtgccgctcggcggcaagctaggattgactctggttcagaggtgattgtcggagtgaataaataccagctcgagaaagaagatgcggtggaggtgctcgccatcgacaatacaagcgtacggaatagacagatagagaagttgaagaaaattaagtcaagtcgggatcaggcactcgctgagcggtgcctcgctgctctcactgagtgtgctgcctctggagatggaaatatcctggctcttgcagtggacgcctcccgggctaggtgcactgtgggtgaaataactgatgctctaaagaaggtctttggcgagcacaaagctaatgatcgcatggtatcaggcgcctatagacaggaattcggtgagtcaaaggaaataacctccgctataaagagagttcacaaattcatggagcgtgagggacgaaggcctcgactcctcgtggcgaaaatggggcaggatggccacgaccgaggcgccaaggtaattgccactggtttcgcagacctgggcttcgacgtcgacataggtcccctgtttcaaacccctagagaggtcgcccaacaggccgtggacgctgatgtacacgcggtcggaatcagcactttggcagccgggcataagactctcgttccagaacttatcaaagaattgaattcgctgggcaggcccgatattctcgtcatgtgtggtggtgtcattccgccacaggattatgagtttttattcgaagtgggagtctccaacgtgttcgggcctgggacgaggatccccaaggctgccgtacaggtgctggacgacatcgagaagtgtctagagaaaaagcaacagtcagtt

SEQ ID NO: 120 - DNA, 2250 bp, Artificial Sequence
  Codon optimized sequence that encodes an MCM polypeptide with the I69V mutation
atgctgcgtgcgaaaaatcaactgttcctgttgtcccctcactacctccgtcaagtgaaagaaagttctggctctcgactcatccagcaacgattactccaccaacagcagccacttcacccagagtgggccgccctggccaagaaacagctcaaagggaaaaatccggaggatctgatttggcacacgcctgaaggcataagcgtgaaacctctgtactcgaagcgggacaccatggacctgccggaggagctgccaggagtcaagccttttactcgtggcccataccctacgatgtatacatttcgtccctggacaattcgccaatacgccgggttttcaaccgtggaggagagcaataaattctacaaggataatattaaggctggtcagcaggggcttagcgtagcattcgatctggctacacaccggggatatgattccgataaccctagagtgcgaggggacgtcggcatggcaggtgtcgcgattgataccgtggaggatacgaaaatcctgttcgatggcatccctttagagaaaatgtcggtctcaatgaccatgaatggagctgtgattccggtgctcgctaatttcattgttaccggtgaggaacagggggtgcccaaagagaagctcacaggaactattcagaacgacattctgaaggagtttatggttcgcaatacatacattttcccccccgagccaagcatgaagatcatcgccgatatcttcgagtacacggctaagcatatgcctaagtttaactccatatccatatccggctaccatatgcaagaagccggcgctgatgctatcctcgagttggcctacaccctggccgacgggctggagtattccagaacaggcttgcaggcgggtctcacgatcgacgagtttgcgccccgtttaagctttttttggggcatcgggatgaacttctatatggaaatagccaaaatgcgggctggtagacgtctgtgggctcacctgatcgagaaaatgttccagcccaaaaattccaagagtttgttactgcgcgcccattgtcagacaagcggttggtctttaacggaacaagatccatacaacaatattgtgcgcaccgcgatagaagcaatggcagccgtgttcgggggcacacagtctttgcacacaaactcattcgacgaggccctgggcctgcccactgtcaagtccgctcgtattgcacgcaacacccagattataatacaggaagaatctggcatacctaaggtcgctgatccctggggaggctcctatatgatggaatgtctgacaaacgacgtgtatgacgcagccttgaaacttattaatgaaatcgaagagatgggaggtatggctaaggccgtggccgagggaattccaaagctcagaatagaagagtgtgccgccaggcgacaggctaggatagatagcgggagcgaggtcatagtcggggttaacaagtaccagctggaaaaggaggatgccgtggaggtcctggccatcgataatacttcagtaagaaatagacagatagagaagctgaaaaagatcaagagttctcgtgaccaagcactggccgagcgctgcctggctgccctgaccgaatgcgctgcctccggagatggcaatattctggcgcttgccgtggacgcatcaagggcccggtgcacagtaggcgaaattaccgatgcactgaagaaggtatttggggaacacaaagccaatgatcgaatggtctcaggggcttacaggcaagagttcggagagtccaaagagataacatctgccattaagcgtgtccacaagtttatggaacgggaaggcagacgtcctaggttgcttgtggccaagatgggtcaggacggccacgataggggggcaaaagttattgccacgggcttcgccgatctcggcttcgatgtcgacatcggacccttgttccagacccctagggaagtggctcagcaggccgtcgacgcagatgtgcatgccgttggtatttcaaccctggccgccggtcataagaccctagtgccagagctcatcaaagagctcaacagcctgggtaggccggatatcctagtgatgtgtggaggagtgattccccctcaggactacgagtttctgtttgaggtcggggtctctaacgtcttcgggccaggcactaggatcccaaaagcagctgtgcaggttcttgacgacattgaaaagtgcctagaaaaaaagcagcagagtgtc

SEQ ID NO: 121 - DNA, 2250 bp, Artificial Sequence
  Codon optimized sequence that encodes an MCM polypeptide with the A499T mutation
atgctgagagcgaagaaccaactgtttctgctcagcccccactacctgcgacaggtgaaggagtcttccggttcaagactgattcagcagcgcctcctgcatcaacaacaacctctgcatcctgaatgggctgcgttagccaagaagcaattgaaaggcaagaatccagaggaccttatttggcacactcctgagggaatttccattaaaccgttgtactctaagagggacaccatggacttacctgaggaactgcctggcgttaagccctttacccgcggaccctatccgacaatgtatacctttcggccttggactattcgccagtatgccggattcagcaccgttgaggaaagcaacaagttctacaaagataacattaaggcaggccaacaggggctttctgtggcttttgacctcgccacccaccgaggttatgactcagacaacccaagagtgaggggtgatgttgggatggccggagtggctatcgataccgtagaagacacaaaaatattgttcgacggaatcccgctagagaagatgtctgtctctatgactatgaatggggctgtcatacctgttctggctaattttatagttacaggcgaagagcaaggagtacctaaggagaagctcacaggcactatccagaacgatatccttaaggagtttatggtccgcaacacatatattttccccccagaaccttcaatgaagataattgcggacattttcgagtacactgccaaacatatgccaaaattcaactccatctcaatctctgggtatcacatgcaagaagctggcgccgacgccatcctggagctcgcttatacactggccgacggactcgaatactcccgcaccggactgcaggctggccttactatcgacgaattcgctccaaggctgtcatttttttggggcatcggcatgaatttttatatggaaatcgctaaaatgagagccgggagacgtctctgggcacacttaatcgagaagatgttccaaccaaaaaattcaaagagcttgctcttaagagcgcattgtcagaccagcggatggagtttgacagagcaggacccctataacaatatcgtccgaaccgccattgaagccatggctgcagtcttcggtggcacgcagtcattgcataccaactcattcgacgaggccctaggtcttcctacagtgaaaagcgcccggatcgctcgaaacactcagattatcatccaggaggaaagcggcattcctaaagtggccgacccgtggggcggcagctacatgatggagtgcctgacaaacgatgtgtacgatgctgcacttaagttgatcaacgaaattgaagagatggggggtatggccaaggcagtggcagagggtatcccaaagctccggatcgaagaatgcgccgccaggagacaggctcgtatcgatagcgggagtgaggttatcgttggcgtgaacaaataccaactggaaaaggaggataccgtggaggtgttggccattgacaacacctcggtgagaaacagacaaatcgagaagctcaaaaaaatcaaatctagcagagatcaggctctggccgagcggtgtctcgctgccctgactgagtgtgcggcaagcggcgatggtaacatcctcgccttggcggtcgacgcctcccgcgccagatgcacggtgggcgagattaccgacgctctgaagaaggtcttcggcgagcataaggcaaacgaccggatggtcagcggagcgtacagacaagagttcggggagtctaaagagattacttcagcgatcaagcgcgtacacaaatttatggagagggagggccgccgtcccaggcttttagtggctaagatggggcaagatggtcacgacaggggggctaaggtcattgcgactgggtttgccgacctaggctttgatgtggacataggccccctgttccaaactcccagagaggtggcccaacaggcggtagatgcggacgtacacgctgtaggcattagcacactggcagcaggtcacaagacgcttgttcccgagctgattaaggaattgaattctttaggaagacctgatatactcgttatgtgcgggggcgtgattccgccccaggactatgagttcctcttcgaggtgggggtgtctaacgtctttggacccggcacacggatcccaaaagccgcggtgcaagtgttagacgacattgaaaagtgtctggagaaaaagcagcaatccgtg

SEQ ID NO: 122 - DNA, 2250 bp, Artificial Sequence
  Codon optimized sequence that encodes an MCM polypeptide with the A499T mutation
atgctgcgtgctaaaaatcaactgttcctgctgagcccacactacctaagacaggtgaaggagtccagcgggtcaagactgattcagcagcgccttttacaccagcaacagcctctgcaccccgagtgggctgccctcgccaaaaaacagttgaagggcaaaaacccagaagatctaatttggcatacccccgaaggcattagcatcaaaccactgtacagcaaacgggatacgatggatttgccagaggagctgccgggggtgaagcccttcacacgcgggccttacccaaccatgtacacattcagaccctggaccatccggcagtatgcaggcttcagcaccgttgaggagagcaataagttctacaaggataatatcaaggcaggtcagcagggactgtctgtggcctttgacctggccactcatcgtgggtatgactccgataatccacgggtacgtggtgacgttggcatggccggtgtcgcaatcgataccgtggaagatactaagatcctgttcgatggtatacccctcgaaaaaatgagcgtgtcaatgaccatgaatggggccgtcattccagtgctggcaaactttattgttacaggagaagaacagggagtgcccaaggaaaaactcaccggcactatccaaaacgatatcctcaaggagtttatggtgagaaatacttatatttttccacccgaaccaagcatgaaaattattgccgatatcttcgagtataccgccaagcatatgccgaaattcaactcgatctcaataagcggctaccacatgcaggaggctggagcagatgctatactcgaactcgcgtatactcttgcggatggcctagagtacagtcggaccggtctgcaggccggattgactatagacgagtttgcgcctcgtttgagcttcttttgggggattggcatgaacttctatatggagatcgcaaagatgcgtgccggccgccggctgtgggcccatctgattgagaagatgtttcaaccgaaaaacagcaaaagcctcttattaagggcccactgccaaacctctggctggtccctgacagaacaggacccatacaataacatcgtcaggactgctattgaggctatggctgcagtgttcggtggaacgcaatccctgcatactaactccttcgacgaggctctcggccttccaacagtcaagagcgctaggatagctcgaaatactcagattataattcaggaagaaagtggtatcccgaaggtggcagacccatggggaggatcctacatgatggaatgtttaactaacgatgtctacgacgcagctctgaaattgatcaatgagattgaggagatgggggggatggcgaaggctgtggcggagggaatccccaaactcaggattgaagaatgtgcggctcgaagacaagctcggatcgacagcggaagcgaggtgattgtgggtgtaaacaagtatcagctagaaaaggaagacacagtcgaggtactggccatagataatacctcggttcgcaaccggcagattgaaaagctgaaaaaaatcaaatcctcaagggatcaggcattggcggaaaggtgtctggctgcccttaccgagtgtgccgcatcaggagatggcaatatcctggccttggcagttgatgccagtcgagctaggtgcacggttggggagatcaccgacgcgctgaaaaaagtctttggagaacataaggccaatgatcggatggtgtccggagcctacagacaggagttcggggaatctaaggagattacaagcgctatcaaacgggttcacaagttcatggagcgagagggacgtaggccacgtcttctcgtggccaaaatgggccaggacggccatgatcgcggggcaaaggtgattgctacaggtttcgctgacctcggctttgatgtagatattggaccgcttttccaaacacctcgagaggtcgcccagcaggccgtagacgctgacgttcatgctgttggcatcagtacacttgcagctggtcataaaactttggtgccagagctgatcaaagaactgaattccctaggccgccctgacatcttagtcatgtgtggaggagtgattcctccacaggactatgagttcctctttgaggtgggagtatccaacgtctttggacccggcacaagaatccccaaagcggccgtgcaagtgctcgatgatattgagaaatgcctggagaagaagcagcaatctgtt

SEQ ID NO: 123 - DNA, 2250 bp, Artificial Sequence
  Codon optimized sequence that encodes an MCM polypeptide with the A499T mutation
atgctgcgcgcaaagaaccaactcttcttgctgagccctcactacctgaggcaggtgaaagaaagctcaggatcgcggctgatccagcagcggctcctgcaccagcaacaacccctgcatccagaatgggctgcacttgccaaaaagcaactcaagggaaagaatccagaggacttgatttggcacaccccagaaggaatttcaatcaagcccctgtattctaaacgggacaccatggatcttccagaggaactgcctggggtcaaaccctttaccagagggccctatccaaccatgtatacattccgcccatggacaatcagacagtatgcaggattcagtaccgtggaagaaagtaacaagttctataaggataacattaaggcaggccagcagggattaagtgttgcttttgatctcgctacccaccgagggtacgattctgacaatccgcgagtccgtggtgacgtcggcatggccggtgttgcaattgatactgttgaggacacgaaaattctgtttgacggaatccctctcgaaaagatgagcgtttctatgactatgaatggcgctgttatccctgttctggctaacttcatcgtgacgggagaggagcagggcgtccccaaggagaaactgacaggcacaattcagaacgatatactgaaagaattcatggtgcgtaacacctatattttcccaccggagccttccatgaaaatcatcgctgacatctttgaatatacagccaagcatatgccgaagttcaactcaatttccatctcaggctaccatatgcaggaggcaggcgcagacgcaatattggagttggcctataccctggcagatgggttagaatattcccgaacgggactgcaagctggactgaccatcgatgagtttgcccctcgcctttcctttttctggggaataggaatgaacttctacatggagattgcgaaaatgcgcgccggtcgccgattgtgggctcacctgatcgagaagatgtttcagcctaaaaatagcaaatctttgctcctgagagcccactgccagacctctgggtggtctctgaccgaacaggacccctataataacatagtgcgtacggctattgaagctatggctgcagtcttcggcgggacacagtctctgcataccaactctttcgacgaggcgctcggactgcccaccgtgaagagcgccagaatcgccagaaatacccaaatcataatccaggaagaatctggaattccaaaagtggcagacccgtggggcggttcctacatgatggagtgtttgacaaatgatgtgtacgacgcagccctgaagttgatcaatgaaattgaggaaatgggcgggatggccaaggcggtcgctgaaggaatccctaagctgcgtatcgaggaatgcgccgcccgacgacaggcgcgcattgacagcggctctgaggtaatcgtgggtgtcaacaagtaccagctggagaaggaagatactgtcgaggtcctggccattgacaatacctcggttagaaacaggcaaatcgagaagctgaaaaaaatcaagagtagccgtgaccaggctttggctgaaaggtgcctggctgctttgaccgagtgcgctgccagcggcgatggcaatatactcgccctagctgtggacgcatcacgggctcgatgtacagtgggcgagattacggatgcactgaaaaaggtgtttggtgagcacaaggctaatgaccgcatggtgtccggcgcctaccgacaggagtttggagagtccaaagaaatcaccagcgccatcaagagggttcacaagttcatggagcgggagggcagacggccccggcttcttgtggccaagatgggccaggatggacacgatcggggagctaaagtcatcgctacgggtttcgcagatttagggtttgatgtggacatcggcccactgttccaaactcccagagaggtggcccagcaagcggtagatgctgacgtgcacgcagtgggtatttctaccctggccgccggacacaaaactctggtgcccgaattgataaaagagcttaattctcttggacgacctgatatccttgttatgtgcggtggtgtgatcccccctcaagactacgagttcttgttcgaggtcggagttagcaatgtcttcgggccgggcacacggatacccaaagctgcagtgcaagtactagatgatattgaaaaatgcctggaaaaaaagcaacagagtgtg

SEQ ID NO: 124 - DNA, 2250 bp, Artificial Sequence
  Codon optimized sequence that encodes an MCM polypeptide with the A499T mutation
atgctgagggccaaaaatcagttgttcttgctgagtccccattaccttcgtcaggtcaaggaaagcagtgggtctcgtctgatccagcaaaggctgctgcatcaacagcagcctctgcaccctgagtgggcagcactcgctaagaagcagctgaaaggcaaaaatccggaagacctaatctggcatactcccgaaggcatatctatcaaacctttgtatagtaagcgtgacacaatggatctgcctgaagagctgccgggagtcaagccttttactaggggcccttaccctacaatgtacactttcaggccctggacaataaggcaatacgctggctttagtacagtcgaggagagcaataaattttataaagataacatcaaggctggacagcaaggcctgtctgtggcctttgacttagctactcatagaggttatgacagcgataatccgcgggtgcgtggcgacgtgggaatggccggagtggccatcgacaccgtagaagacactaagattctgttcgatggaatccctctggaaaagatgtccgtctcgatgaccatgaatggggccgtcatccccgtactagcaaacttcatcgtcactggtgaggaacaaggcgtcccgaaggaaaaactgacaggcacaatccagaacgacatcctcaaagaatttatggtccgaaatacctatattttccctcccgaacccagtatgaagattattgccgatatattcgaatataccgccaagcacatgcccaaattcaattccatttccatttcggggtaccatatgcaggaagctggcgcggatgccatccttgaattggcctacactctcgctgatgggctcgaatattctagaaccgggctgcaggccggattgacaatcgatgagtttgccccacgcctgtctttcttctggggtattggtatgaacttttatatggagatcgctaaaatgcgggccggcaggcggctctgggcgcacctgatcgagaagatgtttcagccgaagaattctaagagcctgctgctgagggctcactgtcagacatcaggttggtccctgacggagcaggacccatacaataatattgttcgaacagccattgaggccatggcagctgtgtttggcgggacgcagtccctacatactaattcgttcgacgaagcgttaggtctccctacagtcaagtctgccagaatagcccgcaatacccaaatcattatccaggaagagagcggcatcccaaaggtagcggacccctggggaggaagctacatgatggaatgcctgaccaacgacgtgtatgacgctgctctgaagctgattaatgagattgaagaaatggggggcatggcaaaagccgtcgccgagggtatccctaagcttagaatagaggagtgtgctgcacgccgccaagcacggatagattcaggatcagaggtcatagtcggcgttaacaaataccagttagagaaggaggacacagtggaagtgctagcgattgataatacttccgtgagaaacagacagattgagaaactgaaaaaaattaagtctagccgggatcaggccctggctgaaaggtgtctggcggctctaactgagtgcgcggccagtggagacgggaatattcttgctttagctgtcgacgcttcgcgggctaggtgcacagtgggtgaaattaccgatgcattaaaaaaagtgtttggggaacataaggcgaacgaccgcatggtgagcggtgcttaccgtcaggagtttggggagtcaaaggagatcacatccgctatcaagagggtgcataagttcatggagcgggaggggcggaggccaagactgttagtagcaaaaatggggcaggacggtcatgataggggtgctaaggttattgcgaccgggttcgcagacctgggtttcgacgttgatatcggacctttattccagacccctagagaggtggcccagcaagctgttgatgctgacgtgcatgctgtgggcatctcaactctcgccgcgggccacaagacactggttcccgagctgatcaaagagttgaactcactggggcggcctgacattctggtcatgtgtggaggagtgatcccgccccaggattacgaatttctgttcgaggtgggtgttagtaacgtgtttggacctggaaccaggattcccaaggcggccgtccaggtcctggacgacatcgagaagtgcttggagaagaagcagcaatccgtg

SEQ ID NO: 125 - DNA, 2250 bp, Artificial Sequence
  Codon optimized sequence that encodes an MCM polypeptide with the A499T mutation
atgctgagggccaagaaccagcttttcctcctgtcacctcactacttaagacaagtgaaagaatcctcaggttctaggctgattcagcagcgcttgctgcatcagcaacagcctctccaccctgagtgggctgctctggctaaaaaacaattgaaaggtaagaaccccgaagatctcatctggcatactcctgaaggaattagcataaagccgctgtactccaagcgagacacaatggatctgcccgaggagttgcctggagttaagccatttaccaggggtccgtatccgaccatgtacaccttcagaccctggacaatcaggcagtacgctgggttctctaccgtcgaggagtccaataaattttacaaagacaacatcaaagctggccaacagggactgtctgtagccttcgatctggccacccataggggctacgattccgataatcccagggtcaggggggacgtgggcatggccggcgtggccatcgacaccgtagaagataccaagatcctctttgatggaattcccctcgagaagatgtcagtgagcatgacaatgaacggggctgtaatccctgtcctcgcaaactttatcgtgacgggagaggagcagggcgtgcccaaggaaaaattgacaggaaccatacagaatgatatcttgaaggaattcatggtgcggaatacctacatatttcctccagaaccgtcaatgaaaattatagccgatatcttcgagtacactgccaagcacatgcctaaattcaattccatcagcatcagcgggtaccatatgcaggaagccggggccgatgctatcctggaactggcctacactctggccgacggactggagtatagtcggaccggattgcaagccggactgactattgatgaattcgcccctagattatcctttttctggggaattggaatgaacttttatatggaaattgctaagatgcgcgcagggaggcggctgtgggcccacttaattgagaaaatgttccagcccaagaatagtaaatcgcttctccttcgagcccactgccagaccagcggttggtcactgactgagcaggacccttataacaatattgttaggacagcaatagaagcgatggctgcagtgtttggaggcactcaatcattacataccaattccttcgacgaagcactggggctgccaaccgttaagagcgctagaatcgcacgcaacacgcagatcatcattcaggaagagtcaggaattcctaaggtggctgatccttggggcggaagttacatgatggagtgtctcacaaatgatgtgtatgatgcagctttaaagcttataaacgagattgaggaaatgggcggcatggccaaagcagtggcagagggtatcccaaagctccgcatcgaggaatgtgctgcacgccggcaggctcgcattgattcaggctccgaagtgattgtgggagtgaacaagtatcagctcgaaaaagaggatacagtggaggtgctggccattgataacaccagcgtccggaatagacaaatcgagaaactgaaaaaaatcaagtctagcagggatcaggcactcgccgaaagatgtttagccgccctgaccgaatgtgccgctagcggtgacggcaacattttggccttggccgtggacgcctcacgcgcaaggtgtacggttggtgaaatcaccgacgctctcaaaaaagtcttcggagaacacaaagctaatgaccggatggtgtctggcgcctaccggcaggagttcggcgaatccaaggaaataaccagtgctataaaacgggtgcacaagtttatggagagggaaggtaggaggcctcgcttactggtcgctaagatgggacaagacggacacgaccgcggcgccaaagtcatcgccacaggattcgcagatcttggctttgacgtcgacataggaccgctgtttcaaactccaagggaggttgctcagcaagcggtagatgcagatgtgcacgctgtcggcatatccaccttagctgcaggtcacaaaaccctggtgccggagttgataaaggagctcaattccttagggaggcccgatatattggtcatgtgcggtggcgtgataccaccccaggactacgagttcctcttcgaggtgggtgtcagtaacgtcttcggtcccggcacaagaatcccaaaggctgctgtacaggttctagacgatattgagaaatgcctggagaaaaagcagcaatccgtg

SEQ ID NO: 126 - DNA, 2250 bp, Artificial Sequence
  Codon optimized sequence that encodes an MCM polypeptide with the A499T mutation
atgcttcgcgccaaaaatcagctgtttttactgagtccgcactatcttaggcaagtcaaagaaagctccggctcacgactgattcagcagcggctcttacatcagcaacaacctctgcatcctgaatgggctgccctcgccaagaagcaacttaaaggaaagaatcccgaggacctcatctggcacactccagagggcatctctattaaacccctgtactccaagcgtgacacgatggatctcccagaggagctgcctggagttaagccgttcacccgtggcccctacccaaccatgtacacctttaggccttggaccattagacagtacgccggttttagcacagttgaagagagcaacaagttctataaggacaacatcaaagctgggcaacagggactgtctgtggccttcgatctggccactcaccgaggttacgatagcgacaatcctcgggtgaggggagatgtgggaatggctggggtggcaattgacactgttgaggatacaaagatcctattcgacggtataccactggaaaagatgtcggtttctatgacgatgaatggagcagtaattcctgtgttggccaactttatcgttacgggggaggaacagggcgttccgaaggaaaagctaacaggtaccatccagaacgatattcttaaggagttcatggtgcgcaacacttacatatttccacctgagccatccatgaagattatagctgatatattcgaatacaccgccaagcatatgcctaaattcaattccatctcaatcagtgggtatcatatgcaggaggccggcgcggacgcaattcttgagctcgcctatacattggcggacggtttagaatatagccggaccggcttacaggccggcctgaccattgatgaattcgcccctcggttgtctttcttctggggaatcggtatgaacttttatatggagatcgcaaaaatgagagcgggccggcgtctgtgggcacatttgatagaaaaaatgtttcaaccaaaaaacagcaaaagcctgcttctgcgagcccactgtcagacaagcggttggtctctcactgagcaggacccatacaataatatagtgcgaacagctatcgaggccatggccgccgtgtttggtggcacacaatctctgcataccaacagttttgacgaggccctgggtctgccaactgtgaaaagcgccaggatagcccgcaatacccagatcataatccaagaagaatctggcattcctaaagtggcagatccttggggaggaagttatatgatggaatgtctgacaaacgatgtctatgacgccgctttgaagctaatcaatgagatagaggaaatgggcgggatggcaaaagccgtcgcagagggcatccccaagctgcggatcgaagaatgtgctgctcgacgtcaggctcgaattgactcaggatccgaggtaatcgtgggcgtaaacaaataccagcttgagaaagaggacaccgtcgaagtgctggccatcgataacaccagcgtcaggaaccgtcagattgagaagctaaagaagataaagagtagtcgcgatcaggccctggccgagaggtgcctggcagcccttactgagtgtgccgcaagtggggacggcaacatcttagcactcgccgtcgatgctagcagggccagatgtaccgtcggggaaattaccgatgccctcaagaaagtgttcggagaacacaaagccaacgatcggatggtcagcggggcataccgccaggagttcggcgagagtaaagaaatcacctctgccatcaaaagggtccataagttcatggagagggagggaaggcgcccccgtttgttagtagccaagatgggccaagatggccacgaccgaggagccaaggtgattgcaaccgggttcgcagatcttggcttcgacgtcgatatcggccccctatttcagacccctagggaggtggcacaacaagcagtggacgcagacgtgcatgctgtggggatctcaaccctggcagccggacataagaccttggtgccggaactgataaaggagctgaattctttgggcaggccagacatcctggtgatgtgtggcggagtaatacccccgcaggattacgagttcctgttcgaggtgggcgtctccaatgtgttcgggccaggtacgcgcattcccaaagccgctgtgcaggtgctcgacgatatagagaagtgtctggaaaaaaagcagcaatccgtc

SEQ ID NO: 127 - DNA, 2250 bp, Artificial Sequence
  Codon optimized sequence that encodes an MCM polypeptide with the A499T mutation
atgctccgcgcaaagaatcaactgttcctgctctcgccacactacttacgccaggtcaaggagagctccgggtcccggcttatccaacagcgtctgctgcatcagcagcagcccctacaccccgaatgggcagctctggcaaagaagcaacttaaagggaagaacccggaagacctaatctggcacaccccagaaggtattagcatcaagccattgtactccaaaagagacactatggatctcccagaggagctgcccggggttaagccattcactagaggaccttatccaacaatgtacacctttaggccctggaccattagacagtatgctggtttttcaacagtcgaggagtctaacaaattttacaaggataatattaaagccgggcagcaggggctatccgttgcctttgatcttgccacccatcgcgggtacgacagtgataatccccgcgtgcgtggagacgtgggtatggccggggttgcgattgatacggttgaagataccaaaatccttttcgacgggattcctcttgaaaaaatgtctgtctcaatgactatgaatggcgcagtgatccctgtactggcaaatttcatagtgaccggggaggaacagggtgtgcccaaagaaaagttaacgggcacgatacagaatgacattctaaaagaattcatggtccggaatacgtatatcttccccccagaaccttccatgaaaattatcgcagatatctttgaatacaccgccaagcatatgcccaaattcaattccatctccatctcgggctatcacatgcaagaggcaggggccgatgctatccttgaactcgcttataccttggcggacgggctggaatacagtcggaccggattacaggccggactgacaatagacgaattcgctcccaggctttcattcttctggggcattgggatgaacttttacatggaaatcgcaaagatgcgagcaggccgacgcctctgggctcatctgattgaaaagatgttccagcccaaaaacagcaaatccctcttactgagagcacactgtcagaccagcgggtggtcgctgactgagcaagatccgtacaataacatagttcgtacagccatcgaggccatggctgcagtgtttggtggcacccagtctttgcacactaattcgtttgatgaggccctaggactgcccacagtaaaatccgctaggatcgcacggaatacccagattatcattcaggaagagagtggcatcccaaaagtggccgatccatggggtggctcctacatgatggaatgcttgaccaatgatgtgtatgatgccgccctgaaactaataaacgaaattgaggagatgggtgggatggctaaggcagtggccgaaggtatcccgaaactcagaatagaggagtgcgctgccaggagacaggcacggattgatagtggtagcgaggttatcgtgggcgtgaataaataccagctggagaaagaggataccgtggaagtcttggcaatcgacaacacatcggtgcggaatcgccagatcgagaagctgaaaaaaatcaaatcctctcgcgaccaggcattggccgagcgatgtctcgccgctttaacggaatgcgcagcaagtggagatggtaatatactggctctggctgttgatgcatctagagcccgctgtactgtgggggagatcacggatgcgcttaaaaaagttttcggcgagcacaaagctaatgaccgcatggtgagtggtgcataccgccaagaatttggagagtcaaaagagatcacttcggccattaaacgtgttcataagttcatggaacgcgaaggcaggagaccgcgactgctcgtggcgaagatgggccaggatggccatgaccggggagcaaaagttatagcaacaggatttgctgacctcggattcgacgtggacataggccctctctttcagacgcctagggaagtcgctcagcaggccgtggacgcagacgtgcacgcagtgggcatttccacgttggcggcaggacacaaaaccttggtccctgagctcatcaaggagctgaattcgctggggcgcccggacattctagttatgtgtggtggcgttatccctccccaggactacgagttcctcttcgaagtgggagtatctaacgtgttcggtcccggcacccggatacctaaggcagccgtgcaggtactggatgacatagagaagtgtctggaaaaaaagcagcagtccgtg

SEQ ID NO: 128 - DNA, 2250 bp, Artificial Sequence
  Codon optimized sequence that encodes an MCM polypeptide with the A499T mutation
atgctacgcgcaaaaaatcagctgttcctgttaagtcctcattacttaaggcaggtgaaggaaagtagcggctcgcgcttaatccagcaaaggctcctgcaccagcagcagccgctgcatcctgaatgggccgctctagctaaaaaacagctgaagggaaagaaccctgaagatctgatttggcacaccccagagggaattagcatcaagccactgtacagtaagcgtgatactatggaccttcctgaagaacttcccggcgtgaagccctttactaggggaccttaccctaccatgtataccttcaggccctggaccattaggcagtatgcaggcttcagcaccgtcgaagaatcaaataagttctacaaggacaacataaaggcgggccaacagggtctgagcgtggccttcgatctggcaacccatagaggctacgacagcgacaaccctcgagtgcggggagacgtcggcatggcgggagtcgccatcgatacagtggaagatacgaaaattttgtttgacggcattcccctcgaaaagatgagcgtgtcaatgaccatgaatggcgccgtcattccagtactggccaattttattgttaccggggaagagcaaggcgtcccaaaggagaaattaacggggaccatccagaacgacatcctgaaggagttcatggtcagaaacacgtatatattccctcctgagccaagtatgaagatcattgcagatatcttcgagtacactgcgaagcatatgccaaagttcaactcaatctccatatcaggctatcacatgcaggaagcaggagcagacgcaatcttggagctggcctacaccctggctgacgggctggagtactcccgaactggattgcaagccggcctgaccatagacgagttcgcaccccgtttgtcctttttttggggcatcgggatgaatttctacatggagattgctaagatgcgcgcaggcaggcgcttgtgggctcatctaatagaaaaaatgtttcaacctaagaacagtaaatcactcctgctgcgtgcgcactgccagacaagcggctggagtcttacagagcaagacccatataacaatatcgttagaacagcaattgaggcaatggccgctgtgtttggcgggacacagtccctacacacaaacagctttgatgaggcactcggcttacccacagtgaagtccgcccgcatagctaggaacacacagatcatcattcaggaagagtccggcatccccaaagttgccgacccttggggcggctcctatatgatggaatgtctcactaacgacgtgtatgacgctgctctgaaattgatcaatgagatcgaggaaatgggtggcatggccaaagcagtcgccgaaggcatcccgaagcttcgaatcgaagagtgtgctgcacggaggcaggccagaatcgacagtggttccgaagtgatcgtaggagtgaacaaatatcagcttgagaaagaagataccgtggaagtgctggccattgacaatacctctgttaggaaccgccagatagagaagctcaaaaagattaagtcttcgcgggatcaggcgcttgcggagaggtgtttagcagccctgaccgagtgtgcggctagtggggacggcaacatccttgcgctggcagtggatgcgagcagagcaagatgtactgtaggcgaaatcaccgacgccctcaagaaggtgttcggcgagcacaaggccaatgaccgaatggtgtctggcgcatatagacaagagtttggtgagagcaaggagatcacatccgcaattaagagagtgcacaagttcatggagcgcgagggaaggcgcccaagattactggttgcaaaaatggggcaggacgggcacgaccggggcgccaaggtgatcgctactggcttcgcagacctgggctttgacgtcgatatcggacctctgttccagacaccaagagaagtagctcagcaggccgtggacgccgatgtgcatgcagtcggtattagtactctggccgccgggcacaagacactggtgccagagctgatcaaggagcttaactcactggggcggcctgatatattggtcatgtgtggcggggtgatcccacctcaagattacgagttcctgttcgaggtgggagtttctaacgtctttggacctggtacccgcatcccgaaagccgcggtgcaggtgctggatgacattgagaagtgcctcgaaaagaagcagcagagtgtg

SEQ ID NO: 129 - DNA, 2250 bp, Artificial Sequence
  Codon optimized sequence that encodes an MCM polypeptide with the A499T mutation
atgctgagggccaagaatcagctgttccttctgagccctcattatctgcggcaggtcaaggagagctcgggatctcgactgattcagcaacgcctcctgcaccaacagcagcctctacacccagaatgggccgccttggcgaagaaacaactaaagggaaaaaatcccgaagacctcatctggcacaccccggaagggattagcattaaaccactctacagtaagcgtgacacgatggacctgcccgaggagctgccaggggtgaaacccttcaccaggggcccttatcccacaatgtatacgtttaggccctggacaatccggcagtacgctgggttcagtactgttgaagaatctaacaagttctataaggacaacataaaggcagggcagcaggggttgagtgtggcatttgacctagctactcatagggggtatgactctgacaatcccagagtaaggggcgatgtagggatggcgggggtcgccattgatactgtcgaggacaccaagatactgtttgatggaatcccgctcgaaaagatgagcgtgtccatgactatgaacggcgcggtgatcccagtgctggccaacttcatcgtcaccggagaggaacagggagtgcctaaggaaaagttaactggtacgatccagaacgacattttaaaggaattcatggtcaggaatacctatatattcccacctgaacctagcatgaagatcattgcagacatattcgagtacaccgctaagcatatgcctaagttcaatagcataagtatcagcggataccacatgcaggaggcaggggcagacgccatcttggaactggcctacacactggccgacggactcgagtattcgagaacgggtctgcaggccggtctgaccatcgatgagtttgcgccaagactgagctttttttggggaattggcatgaacttttatatggagattgcgaaaatgcgggccggcaggcgcctctgggcgcacttgatcgagaagatgtttcagcccaagaattcaaagagtctgctcctgagggcccactgtcagacctcgggatggtctctcacggagcaggacccatacaataacatcgtcagaaccgccattgaagcaatggccgctgtgttcgggggaacgcagagtcttcatacgaactccttcgatgaggcacttggacttcctacagtcaagtcggccagaattgccagaaacacccaaattatcatccaggaggaaagcggaattccgaaagttgcggacccatggggaggctcctatatgatggagtgcctgaccaatgatgtctacgacgccgccctgaagctgatcaatgagattgaagagatgggcgggatggccaaagccgtggccgagggtatccctaaactcaggatcgaggagtgcgctgccaggagacaggcgcggattgattctggttcggaagttatcgttggcgtgaataagtaccagctggagaaagaggacacggtggaagtgctggctatagataacacaagcgtgcgtaacaggcagatcgaaaagttaaaaaagattaagtcctctagggaccaagcgttagctgagaggtgcctcgctgctctgactgagtgcgccgccagtggcgatggaaatatcctcgccctcgccgtagacgcttctagagcacggtgtaccgtcggggaaatcaccgacgcacttaaaaaggtgttcggagaacataaagccaacgatcgaatggtgtccggcgcctacaggcaggaatttggggagagcaaggaaattactagcgcgattaaacgagtccataaattcatggagcgggagggacgacgaccacgactgcttgtagcgaagatggggcaagacggacacgacagaggcgctaaggtaattgctacgggatttgctgatcttggctttgacgtggatatcggcccactgtttcagacaccacgggaagttgcccaacaggctgtagatgccgatgttcacgccgtcgggattagcaccttggcggcaggtcacaagacgcttgttcctgagctgatcaaagagctgaattccttggggaggccagacattctcgtcatgtgcggcggcgtcattccgccccaggattatgaatttctttttgaggtgggagtttccaatgtgtttggcccaggaacccggattcctaaggcggccgtccaggtgctcgacgatattgaaaaatgtctggagaagaagcagcagagcgta

SEQ ID NO: 130 - DNA, 2250 bp, Artificial Sequence
  Codon optimized sequence that encodes an MCM polypeptide with the A499T mutation
atgctgcgggccaagaaccagctctttctgctcagcccccattacctcaggcaggtgaaagagtcatctggatccaggcttatccagcagagactgctacaccagcagcagccactgcatccagagtgggcggccctcgctaagaaacaactgaaaggcaagaatcccgaagatctaatctggcatacacctgaggggatcagtatcaaacctctgtacagcaaaagggacactatggatttaccggaagaacttccaggcgtaaaaccattcactcgcggcccatatccgaccatgtacacatttaggccatggactatacgccagtacgctggcttttccaccgttgaagaatcgaataagttttacaaagataatatcaaagctggacagcaaggtctgtctgtcgcatttgacctcgcaacccacaggggatacgactctgacaaccctcgagtccgcggcgatgttggcatggccggagttgcgatcgacactgtggaagacacaaaaatcctgtttgacggaatcccacttgagaaaatgtcagtgagcatgactatgaatggggcggtgatccctgttttggccaactttattgtgacaggggaggagcagggcgtgcctaaagaaaaattgactggtaccattcagaatgatatactgaaggaattcatggtgcgcaatacctacatcttccccccggagccgagtatgaagatcatcgctgacatatttgagtatactgcgaaacatatgcctaagttcaactcaatatctattagtggctatcacatgcaggaggctggggccgatgccatattagagttggcttatacacttgccgacggcttggagtactcgaggaccggtctgcaggctggcctcacgatcgatgagttcgctccaagattgagctttttctgggggattgggatgaacttctatatggagatcgccaagatgcgggctggccgccgcttatgggctcatctgattgagaagatgtttcaacctaaaaactcaaagtctctgctgttgagagcccactgtcagacgtcaggctggagcctgacggagcaggatccctacaataatattgtgcggacagcgattgaagccatggcagctgtatttgggggcactcagtccttgcacaccaacagcttcgacgaagctttagggctccctactgtcaagtcagccagaatcgcccggaacactcagatcatcatacaggaagagagcggcattcctaaggtagcggatccctggggtgggtcttacatgatggagtgcctcacaaatgatgtctacgatgccgccctcaagttgatcaatgagatcgaggagatgggaggaatggcaaaagccgtcgcagaggggatacccaaactgcggattgaggagtgcgccgcgcgccggcaggctcgcatcgatagtggaagcgaggtgattgtcggtgttaacaagtatcagttggagaaggaagacacagttgaggtgctggctattgataatacatcagttcgtaacagacagattgaaaaactgaagaaaataaaatcatcaagggatcaggcattagccgagcgttgtttggccgcgctgacagaatgtgccgcatcaggtgacggtaatatactggccctggctgttgatgcgagcagggctcgctgcactgtgggggagatcacagacgcactgaagaaggtcttcggggagcataaagcaaacgacaggatggtcagcggggcatatcgccaagaattcggggagtccaaggagatcacttcggccattaagagagtccacaagtttatggaaagagagggtaggcgcccccgcctcctggtcgccaaaatgggacaagatgggcatgaccgtggcgccaaagttatagcaacgggatttgcagacctcgggttcgatgtggacattggacctcttttccagacaccccgcgaagtggcgcagcaggcagtggacgcggatgtacacgccgtaggcatctctacattggcggctggtcacaagacgcttgtccctgagctcatcaaagagctgaacagcttaggccgccctgacatcctggtcatgtgtggcggagttattcctcctcaggattacgaattcttgtttgaggtgggcgtgagtaacgtgttcggacctggaactaggattccaaaagcagccgtacaagttttagacgacatcgagaagtgcttggaaaaaaaacaacagtctgtg

SEQ ID NO: 131 - DNA, 2250 bp, Artificial Sequence
  Codon optimized sequence that encodes an MCM polypeptide with the R532H mutation
atgctgcgagcaaagaatcagctgttcctactatcgcctcactatcttaggcaggtgaaggaatccagcgggtctagactcatacagcagaggctcctacatcaacagcagcccctacaccctgagtgggccgccttagccaagaagcagctcaaaggtaagaacccagaagatctgatctggcatacccctgaaggcatctccattaagccattatattctaagcgggacactatggatcttccagaggaattgccaggggtaaaaccattcacccgagggccctatcccacgatgtacactttcagaccttggaccatcagacaatatgcagggttctcaacagttgaggagtctaacaagttctataaagacaacatcaaggctggacaacagggattgtcagtggcatttgatttagccacccatcgggggtacgattctgataatccaagggtgagaggtgacgtgggaatggcaggggtggccattgataccgttgaggacaccaagattctctttgacggtatccctctggagaaaatgagcgtgtccatgactatgaatggcgcggtgatccccgttttggccaatttcatcgtcactggggaggaacaaggcgtcccgaaggagaagctgacaggaactatccaaaatgatatcctgaaagagttcatggtccgcaacacatatattttcccacctgaaccgtccatgaaaattattgcagacatcttcgaatacactgcgaaacacatgccaaagttcaacagtatcagtatctccggctaccatatgcaagaggctggagctgacgcaatcctggaactggcttacacattagccgatggtttagagtactcccgtacagggctacaggctggtctgactatcgatgagtttgccccacgactcagtttcttctgggggataggtatgaatttctatatggagatcgccaagatgagagcaggcaggcgcctttgggctcatctcatcgagaaaatgtttcagcccaaaaatagcaagtccctcctactcagagcccactgccagaccagcgggtggtctctcacagagcaggatccttacaacaacatcgttcggactgcaatcgaagccatggcagcagtgtttgggggcactcagagcctgcatacaaactcattcgatgaggccttgggtctccctacagttaagtctgcccgaatcgccagaaacactcagatcatcatccaggaggagtccggcatcccaaaggtggcagacccgtggggtggcagttatatgatggaatgtcttaccaatgacgtgtacgacgctgctctaaagttaataaacgaaattgaggaaatgggagggatggcgaaagctgtcgccgaaggaatcccaaagcttcggattgaggagtgcgctgctaggcgtcaggctagaatagactcggggagcgaagtcatagtgggagtcaacaagtaccagctggaaaaggaggacgccgtcgaggtgctggccattgataatactagcgtacgaaaccggcaaattgaaaaactgaagaaaatcaagagctctagggaccaggctctggccgagcactgcctggctgccctgacagaatgcgctgcatctggggacggcaatatcctggctctggctgtcgatgccagtcgagcccggtgcaccgtgggcgaaatcactgacgctctcaagaaagtgtttggcgagcataaagcaaatgatcgcatggtgtctggcgcctaccgccaagagttcggcgaatctaaggaaataacttctgcaataaaacgggtccacaaatttatggagcgcgaagggcgtaggccgaggcttctcgtcgctaagatgggccaggatggccatgatagaggtgccaaagtgatcgctactggattcgcggacctgggcttcgatgtggatattggtcccctcttccagacccccagggaagtggcccaacaggctgttgacgcagatgtgcacgctgtgggaatcagcaccctggctgctgggcataaaaccctcgtaccggaattgattaaggaattaaacagcttggggcgtcccgacattctggtcatgtgtgggggggtgatcccaccacaggattacgagtttctcttcgaagttggagtcagtaatgtctttggtcctggtacaaggattcccaaggctgctgtgcaagtcctggacgacattgagaagtgcttagagaagaagcagcagtctgtg

SEQ ID NO: 132 - DNA, 2250 bp, Artificial Sequence
  Codon optimized sequence that encodes an MCM polypeptide with the R532H mutation
atgctaagagctaagaatcagctgtttctcttatcaccccactacttacgccaggtgaaggaatcatctggatcgagactaatccagcagcgtctgcttcatcagcagcagcccttacatccggaatgggcagcacttgctaaaaaacagctcaagggaaagaatcctgaagatcttatctggcacactccggagggcatctcaatcaaaccgttgtatagcaaacgcgatacaatggatctacccgaggaactgccaggagtgaaaccattcacccgcggaccctaccccactatgtacactttccggccctggacgatccggcaatacgccggcttcagcaccgtggaggagtcaaataaattctataaggataatatcaaggcgggacagcagggtcttagtgtggcgttcgatcttgccacacatagaggatacgattcggacaatccacgcgtacggggagatgtcggcatggctggggtcgccatagatacagtcgaagacactaagatcctcttcgacggaatcccccttgaaaagatgagtgtgtcgatgacaatgaacggggccgtcattccggtgctagccaattttatagttactggagaggagcagggcgtgccaaaggagaaactcacaggtacaatccagaatgacattctgaaagagttcatggtacgcaacacttacatctttccacccgagcccagtatgaaaataatcgccgatatcttcgagtacacggcaaaacacatgccaaaatttaattccatcagcatttccggatatcacatgcaggaggccggggccgacgcaatcttagaactggcctacaccctggcggacggattagagtattctaggaccggcctgcaggccggcttaactattgatgaattcgctcccagattgagtttcttctggggaataggtatgaatttctacatggagatcgcaaagatgcgtgccggacggcgcctgtgggcccacctaattgagaagatgtttcagccgaagaatagcaagtctcttctcctgagggcccattgtcagaccagcggctggagccttacggagcaggatccttacaacaatattgtgagaaccgccattgaggccatggccgccgtcttcggtgggacccagtcgctgcacacaaactcctttgacgaggccctgggtttgccgacggtgaaatcggcgcgcatcgcccggaatacccagatcatcatccaggaggagtccggaatcccaaaggtcgctgatccttggggaggtagttacatgatggagtgtctgactaatgatgtgtacgatgcggccctgaaactgatcaacgagattgaagaaatgggggggatggcaaaggccgtcgccgagggcatcccaaagttgcgcatcgaagagtgtgctgcacggagacaggctagaatcgattctggttccgaggtcattgtcggggtgaacaaatatcaactggagaaagaagatgcagtggaagtgctggcaattgataacacaagcgtgcgcaaccgccaaatcgagaaactgaaaaaaattaaaagctctcgggatcaagccctcgcagaacactgccttgcagctctcacggagtgcgctgcttccggagatggaaacatcttagcgctggcagttgatgcatcccgagcccgctgcaccgtaggggagattacagacgcattgaaaaaggtttttggtgagcataaagccaatgatcgcatggtaagtggagcatatagacaggagtttggggagagtaaggaaataacaagcgccatcaagagggttcacaagtttatggaacgggaggggagacgcccacggctcttagtggcaaaaatgggacaagacggccacgaccggggcgctaaagtgatcgccaccggcttcgcggacctgggatttgatgtggacatcggtccgctgttccagactccgcgggaggtagcccagcaggcagtggacgccgatgtccatgcggttgggattagcacactggcagctggacacaagaccttggtgcccgagctgattaaggagttaaactcactggggcgacccgatatacttgtgatgtgtggcggagttatcccgccccaagactacgagttcttattcgaggtgggtgttagcaacgtatttgggccaggcactaggatccctaaagctgctgtgcaagtcctagacgacatcgaaaagtgtctagagaaaaaacagcagtctgtc

SEQ ID NO: 133 - DNA, 2250 bp, Artificial Sequence
  Codon optimized sequence that encodes an MCM polypeptide with the R532H mutation
atgctccgtgccaaaaatcagctctttctattatctccacattacctacggcaagttaaggagtcttctggctcgcggctcattcaacagagattactacaccagcagcagcccctgcatcccgagtgggcagcattggccaagaagcagctgaaaggtaagaatcccgaggacctgatctggcacacccccgaaggaatctctattaaacccctttacagcaaacgcgacaccatggacctgcccgaggagctgcccggggtgaagccatttactagagggccatacccaaccatgtacacatttagaccctggacaattagacagtacgcgggctttagtacagtcgaagagagcaacaaattttataaggacaatatcaaggccgggcaacagggcctctcagtggcctttgacttggctactcacagaggctacgatagcgataacccccgggtacgtggcgatgtgggtatggccggagtggcaatcgataccgttgaagacactaagattcttttcgacggcattccacttgaaaagatgtctgtcagtatgacaatgaatggtgctgtcatcccggttttggccaattttattgtcacaggcgaggaacaaggcgtgccgaaagagaagttaacaggcactattcagaatgatatcctcaaggagttcatggtgcggaacacttacatcttcccaccagagccatcgatgaagataatcgccgacatcttcgagtataccgctaagcacatgcctaaatttaacagcatttctatctccggctaccacatgcaggaggccggcgcagatgcaatcctggagctggcttatacgctggccgacgggcttgaatacagccggaccggcctccaggctggcctgacgatcgacgaatttgccccccggctttcttttttctggggcatcggaatgaacttctacatggagattgcgaaaatgcgagctggtcggcgcctctgggcccatttgatcgagaaaatgttccagccaaagaactcaaagtcactgttactacgagcccattgccagacatcaggctggtccctaaccgagcaggatccctacaataatatagtgcgaactgcaatcgaggctatggctgccgtgttcgggggaactcagtcactgcataccaactcatttgacgaggcactcggtttgccaacggtgaagtccgctaggatcgcacggaatacccaaataattatccaggaggaatctggtattcctaaggtggcagatccctggggcggtagctacatgatggagtgtctcaccaacgatgtgtatgacgcggctctgaagctgattaacgagattgaggagatggggggaatggcgaaagctgttgccgaaggcattcctaagctgcgcatcgaggagtgcgcagcccgccgtcaggccagaatcgatagcggttccgaagtaatcgtgggagtaaataaataccagctggaaaaggaggatgctgtagaagtgctcgccatagataacacttcagttcgtaataggcagatcgaaaaactgaagaaaataaaatcctcccgtgatcaggctcttgccgaacattgcttggcggccctgacagagtgtgcagcctccggggacggcaacatcctggctctggcggtcgacgcaagccgggcccggtgcactgtgggtgagattacagacgctctgaagaaagtattcggcgagcataaggcgaatgataggatggtcagcggtgcttaccgccaggagtttggcgagagcaaagaaattacctctgctataaaaagggttcacaagtttatggagagggagggacgtagacctaggcttctggtcgcaaaaatgggccaggatggccacgacaggggggctaaagtgattgcaactgggtttgcagaccttggttttgacgtagacataggacctttgttccaaacccctcgcgaagtcgctcagcaggctgtcgacgccgatgtgcacgccgtcgggatttcgaccttggctgctggtcacaagactttggttcccgaattaataaaggaattaaactcgctcggccgacctgatatccttgtgatgtgcggcggggtcatcccaccccaggactatgaatttctcttcgaggttggcgtgtctaacgttttcggccccggaacacggattccaaaagcggctgtgcaggtgctggatgacatcgagaagtgtttagagaagaaacagcagtccgta

SEQ ID NO: 134 - DNA, 2250 bp, Artificial Sequence
  Codon optimized sequence that encodes an MCM polypeptide with the R532H mutation
atgctgcgcgccaagaaccagctcttcctgctttctccccactacctaaggcaagtgaaggaaagtagcgggagccggctcatccaacaaagattgctacaccagcagcaacccctgcacccagagtgggctgcactggccaaaaagcaacttaagggcaaaaatccagaggatctgatctggcacaccccagagggaatctctatcaaaccactctactctaagcgggataccatggaccttcccgaggaactgccaggggtgaagcccttcactagaggaccctacccgaccatgtacacatttcggccatggaccatccgacagtatgccggtttttctacagttgaggaatccaataagttctacaaggacaacatcaaggcagggcaacagggcctttccgtcgcgtttgacctcgcaacacacaggggctacgatagtgataacccacgggtaagaggagatgttgggatggccggcgtggctatagacactgtggaggatacgaaaattttattcgatgggatccccctggagaagatgagtgtgagcatgaccatgaacggcgctgttatacccgtccttgcaaactttatcgtcacaggtgaggagcagggtgtgcccaaagagaagctcacgggtacgatccagaacgacattcttaaggagtttatggtgagaaatacatatatcttcccccctgaaccttccatgaagattatcgctgatatcttcgagtacaccgccaagcacatgccaaaatttaactccattagtatctcagggtaccacatgcaggaggccggcgccgacgcaattctcgagcttgcatatacactggcagacggactcgaatattcacgcacaggccttcaggcaggtctcactatcgatgagtttgctcctcgactgtcttttttctggggtatcggcatgaatttttacatggaaatcgctaagatgcgcgccggaaggcggttgtgggcccatctgatcgagaagatgttccaaccaaaaaacagtaaatcccttcttctgagagcgcactgccagaccagtgggtggagtttaactgagcaggatccgtacaacaatatcgttcgaaccgccattgaagcgatggcggcggttttcggcggcacacagtccttacatacgaattcattcgacgaggccttgggcctgccgaccgtcaagtcagcaaggatcgcgagaaacactcagataataatccaggaggagtccggaatacctaaggtggccgatccttggggtggatcttatatgatggaatgcctgactaacgatgtctacgatgccgcgctgaagctaataaatgaaatcgaggaaatgggaggtatggccaaggccgtagctgagggtattccaaaactgcgtatcgaggaatgcgctgccagaaggcaggcgagaatcgattcaggcagcgaggtcattgtaggcgtaaacaaataccagttggagaaggaagacgcagttgaggttctcgctattgacaatacatctgtgcgaaaccggcagattgaaaaactaaaaaaaattaagagctcgcgggaccaggcactggctgagcactgcttggctgcactgaccgagtgtgcagccagtggtgatggaaatatcctggccctcgccgtcgacgcctcacgagcccggtgcaccgtgggcgagattactgacgcactgaagaaggtgtttggcgaacacaaggcgaacgaccgaatggtatcaggggcctaccgccaggaatttggagagtcgaaggagatcacaagtgctatcaaacgcgttcacaagttcatggagcgcgaagggcgccggccgcgtctactcgtagccaagatgggacaggacggacacgaccggggagctaaggtgatagcgaccggcttcgccgatctggggtttgacgtggacattggaccattgttccagacgcctcgagaggtggcccagcaagccgtcgatgccgatgtccacgcggttggcatatctacccttgccgctgggcacaagaccctcgtacctgagttgataaaagagttaaactccctggggaggccagatattctggtcatgtgtggtggtgtcatcccaccccaggattatgagtttttattcgaggtgggtgtcagcaatgtctttggcccggggacacgcatccccaaggccgccgttcaggtgttagatgacattgaaaagtgcttggagaaaaagcagcagtccgtt

SEQ ID NO: 135 - DNA, 2250 bp, Artificial Sequence
  Codon optimized sequence that encodes an MCM polypeptide with the R532H mutation
atgctgcgcgcaaaaaaccagctgtttctcctcagtccccactacctgcggcaggtgaaggagtcttccggcagtagactgatacagcagcgccttctccaccagcagcagccactgcacccagagtgggccgcgctcgcaaaaaaacaactgaagggcaagaatcccgaggacctgatctggcatactccggaaggcatcagcattaagccactttacagtaaacgagacaccatggatctgccagaggaactaccaggcgtgaagcctttcacaagaggaccttacccaacaatgtatactttccgtccatggactattcgacagtatgcggggttctcaacagtggaggaatccaataagttctacaaagacaatatcaaggccggccaacagggcctgagtgttgccttcgacttggccacccaccgtggatacgattctgacaacccaagggtgcgtggtgacgtcggaatggcaggcgtggcaatcgataccgttgaagacaccaaaattctcttcgacggaatcccacttgagaagatgagcgtaagcatgacaatgaacggagctgtgatccctgttctggcaaattttattgtgacaggtgaggaacaaggggttcccaaggaaaagctaacgggcactatccaaaatgatatattaaaggagttcatggtgcgtaacacctatatttttccaccagaacccagcatgaaaatcatcgccgacatttttgaatatactgcaaaacatatgcccaagttcaattccatcagtatatccgggtaccacatgcaagaagccggagccgatgcaatcctcgagctggcctatactctcgccgatgggttagagtacagtcggactggcctccaagcagggctaactatcgacgagttcgccccaagattatctttcttctgggggataggtatgaatttttacatggagatagccaagatgcgggcaggaaggcgactgtgggcccatttgatcgagaaaatgtttcagccaaagaatagcaaatccttgcttctcagggctcattgtcaaaccagcggatggagcctgacagagcaggatccctacaacaacatagtgcggacggctatcgaggccatggccgccgtgtttggggggactcaatccctgcataccaattcgttcgatgaggctctgggactgccaactgtcaaatcagcccgcattgcacgcaatactcagataattatccaggaagaaagcggcatccctaaggtcgccgacccctggggcgggagctacatgatggagtgtctcacaaacgatgtttatgacgccgctctgaaactcattaacgaaatagaggaaatgggaggtatggccaaagcagtggccgagggtatcccgaaactccggattgaggagtgtgcagctaggcggcaggcacgcattgatagtgggagcgaggtgattgtgggcgtgaacaagtaccagctcgaaaaagaggacgccgtcgaagtactggctatagataacacttctgtaagaaatcgccaaattgaaaaattaaagaagataaagagtagccgcgaccaggctctagcagagcactgtctcgcagcactcaccgagtgcgctgcaagtggggatggtaatatcctggctctggctgtggacgcaagccgggcccggtgtacagtaggcgaaatcaccgacgccctcaagaaagtttttggcgagcataaggccaatgaccggatggtgagcggcgcctatcggcaagaatttggcgagtccaaagagattaccagtgctatcaaacgggtgcataagttcatggaaagagagggccggcgccctcggcttttggtggcaaaaatgggccaagatggtcatgatagaggcgcgaaagtcatcgcaaccggcttcgccgacctgggcttcgacgttgatattggcccactattccagacccctagagaagtggcccaacaggccgttgatgccgacgtgcacgcagtgggtattagcacacttgcagctggccacaaaacactggttcctgagctcatcaaagagctgaatagcttaggccggcctgatatcctggtgatgtgcggcggcgttattccgccccaggattatgaattcctgtttgaggtcggtgtgagcaatgtcttcggtccaggaacaagaattcccaaggcagccgtgcaggtactcgatgacatcgagaaatgcctggagaagaagcagcagagcgtt

SEQ ID NO: 136 - DNA, 2250 bp, Artificial Sequence
  Codon optimized sequence that encodes an MCM polypeptide with the R532H mutation
atgctgcgcgccaagaaccagttgttcctattaagcccccactacctcaggcaggtgaaggagtcaagtggatctcgactgatccaacaaagattattgcaccagcagcagcccctccatcctgagtgggccgctcttgcgaagaaacagctcaaggggaagaatcctgaggacctgatttggcacaccccagaaggaatcagcatcaagcccttgtatagcaagagggacaccatggatcttcctgaggagctcccgggtgtgaaaccattcacaagggggccgtatcccacaatgtacacttttcgaccctggacgatccggcagtacgcaggattctcgactgtggaagaatccaacaagttttataaagataacatcaaggccggccagcaaggactgtctgttgctttcgacctagccacccacagggggtatgacagcgataatccgcgcgtaaggggagatgtgggcatggctggcgtggcaatcgacaccgttgaggacaccaagatattattcgatgggatcccactggagaagatgtccgtctccatgaccatgaacggagcagtcatacccgtgttggcgaactttatcgtgaccggggaagaacaaggtgttccgaaagaaaagctgacgggcaccattcaaaatgacattttgaaagagttcatggtacgcaatacctacatcttcccccctgagccctctatgaagatcatcgcagacatcttcgaatacacggccaagcatatgccaaagttcaatagtatcagtatcagtgggtaccatatgcaggaagccggcgcggatgccatcttggagttggcctatacattggcagatggccttgagtattctaggacaggactccaagccggcctgacaattgacgagttcgctccacgcttgagcttcttctgggggatcggaatgaacttttacatggagattgccaaaatgagagccgggcgccggctttgggcacacctgatcgaaaagatgttccagcccaaaaactctaaatctcttctgctacgcgcccattgccagaccagtggatggtcacttactgagcaggatccttataacaacatcgtcagaacagccattgaggccatggccgcagtatttgggggcacccagtccctgcatacaaacagctttgacgaagccttgggactgcctacagtgaaaagtgccaggatagctcgcaatacacagatcattatccaggaggagagtggcatcccaaaggttgcggacccgtgggggggcagttatatgatggaatgcttaaccaatgatgtgtatgacgcggcgctgaaactgatcaacgaaatagaagaaatgggcgggatggcaaaagctgtggccgaaggaattcccaagctgagaattgaagaatgcgcagcccggcgtcaagccaggatcgacagcggatccgaagttatcgtgggggtaaataaatatcagcttgaaaaagaggatgcagtggaagtcttggcaatcgacaatacgtctgtacggaatcggcagatcgaaaagctcaagaagataaagtcaagtagggatcaggcccttgctgagcattgccttgctgctttaacagaatgtgccgccagcggggatggcaacatcctagccctagctgtggacgcttcgagggctaggtgtaccgtgggggagataaccgatgcactgaagaaggtctttggagagcacaaagcaaacgatcgcatggtgagtggggcctacagacaggaattcggtgaaagcaaagaaattacaagcgcaatcaagagagtgcataagttcatggaacgagagggaaggagacctcggctgctggtggcgaaaatgggtcaagacgggcacgacagaggagccaaagttattgcgaccggattcgctgatttggggtttgacgtcgatatcggaccactgttccagaccccccgagaagtagcgcagcaggctgtggatgcagacgttcatgctgtaggtatttcaacactggcagcaggccacaagaccttggtccctgagctgataaaagagctcaattctttgggcagaccagatatactcgtgatgtgcggaggtgtgatccccccacaggactatgagttcctgttcgaggtgggagtgtcaaacgttttcggccctggaacgcgaatccccaaagcagcagtgcaggtcctagatgacatcgaaaaatgcttggagaagaagcagcaatccgtg

SEQ ID NO: 137 - DNA, 2250 bp, Artificial Sequence
  Codon optimized sequence that encodes an MCM polypeptide with the R532H mutation
atgttgcgagctaagaatcagcttttcctcctatcccctcactacctccgacaagtgaaggagtccagtggttctagactgatccagcaaaggcttctgcaccagcagcaaccgttgcaccctgagtgggctgctctcgccaagaaacaactgaaggggaaaaatcctgaagatctcatctggcacacccctgaaggcatttccatcaagcccctctacagcaaacgagataccatggatctgcccgaggagctgcccggagtaaagccttttaccagggggccctatcccaccatgtatactttccggccttggactattagacagtatgccgggttttctacggtggaggagtcaaataagttttacaaggataacatcaaggctggtcagcaaggcctgtcagtggcttttgatctcgcgactcatcggggttacgattccgataatccacgggtgcgaggagatgtgggcatggctggggtcgccattgacacagtggaggacacaaagatccttttcgacggcatccctctggagaaaatgagcgtgagcatgaccatgaatggtgccgtgataccagtgctggccaattttatcgtgactggggaggagcagggagtgcccaaggagaagctgacaggaacaattcagaatgacatactgaaggagtttatggtaagaaacacctacatctttcccccagaacccagcatgaagataattgccgacatcttcgaatataccgcgaagcacatgccgaagttcaactctatcagcatctctggatatcacatgcaggaagcaggagccgacgccatccttgagcttgcgtacactttggccgacggccttgagtactcacggaccggccttcaggcaggacttacaatagacgagttcgccccgagactgtcctttttttgggggattgggatgaacttttacatggagattgccaaaatgcgggccgggagaagattatgggcgcacctgatcgagaaaatgttccagcctaagaactccaagtcactgcttctgcgggcccactgtcagaccagcggctggagtctgactgagcaggacccttacaacaacatcgtgcgcaccgcaatagaggccatggctgctgtgtttggagggacccagtctcttcataccaattccttcgacgaggcactgggcctgcccaccgtgaaatctgcccgtattgcccggaacactcagatcatcatccaggaagagtctggcattccgaaagtggcggacccctggggaggatcgtatatgatggagtgtttgaccaatgatgtctacgacgctgcactgaaacttatcaacgagatcgaggaaatgggtgggatggccaaggctgttgccgaggggatccctaaactccgaattgaagaatgtgccgcacgccggcaggcccgcatagactcgggctcagaggtcattgttggggtaaataaataccagttggagaaggaggatgccgttgaggtcctggccatcgataacaccagcgtgagaaataggcaaattgagaagctgaaaaaaattaagtcttcaagggatcaggccctggcggagcactgtctagccgccctaactgagtgtgccgcctcaggcgatggcaacattctggctctggctgtggacgcgtcccgcgctaggtgtacagtgggtgagattacagacgcactcaaaaaggtgttcggggaacacaaggctaacgaccgtatggtgtcaggagcctaccggcaggagtttggcgaatcgaaggaaataacatcagccattaagagggtgcacaagtttatggagagagagggaagacgcccccggctgctagtggcaaaaatgggccaagatggccacgaccggggagcgaaagttattgcaacagggttcgcagatttgggattcgacgttgacatcggtccgctgtttcagacaccccgagaggtggcacagcaggctgttgacgcggatgtgcacgccgtggggatttctacgctcgccgccggacataagacgctagtcccagagttgattaaggagcttaactccctgggcaggccggatattctggttatgtgtgggggagtcatcccgccacaggactacgagttcctgttcgaagtcggggtctctaatgtgtttggaccgggcactagaatcccaaaggccgctgtgcaggtcctggacgatatcgagaaatgtctcgaaaaaaagcagcagtcggtg

SEQ ID NO: 138 - DNA, 2250 bp, Artificial Sequence
  Codon optimized sequence that encodes an MCM polypeptide with the R532H mutation
atgctgagggccaagaatcaactgttccttctgtcccctcactatctgcgccaggtcaaagagtcatccggcagcaggctcatacagcaaaggctgcttcaccagcagcaacccctacacccagaatgggcagctttggcgaaaaagcagttgaaaggtaagaacccggaagacctgatctggcacacccccgagggcatttcaatcaaacccctgtatagcaaacgggacacaatggaccttcctgaggaattgccaggggtgaaacccttcacccgagggccatacccaactatgtacactttcagaccttggaccatcagacagtatgctggatttagcacggtggaggaatcaaacaagttttacaaagataatatcaaggccggtcagcaggggctgagcgtcgcgttcgacctggcgacacaccggggatatgattccgataatcctcgggtcagaggggatgtggggatggccggcgttgccattgataccgtcgaggacaccaaaatactgttcgacggaatccccctcgagaaaatgagcgtgtctatgacaatgaatggggctgttattccggtcctggcaaattttatcgtcacaggagaggagcagggggttcctaaagagaagctgacaggtacaatccagaatgatatcctcaaggaatttatggtcaggaatacctacatcttcccgcctgagccatcaatgaagattatcgccgacatttttgaatatactgccaaacacatgcccaaattcaattctatctccatatctgggtaccatatgcaggaggccggcgccgacgccatccttgaactcgcttatacactcgccgatggactggagtattctcgcactgggttacaggccggcctcactattgatgaattcgcaccaagactaagctttttctgggggatcggcatgaatttctatatggaaatcgctaagatgcgggccggaagaagactgtgggctcatctgattgagaaaatgtttcagcccaagaacagtaaatccctgctgctccgcgcacactgccagacatcaggttggtctcttaccgaacaggacccctataataacatcgtgaggactgccattgaagcaatggctgctgtgttcggggggacccaatctctgcacacaaactctttcgacgaagccctgggcctacctacagtcaagagcgccagaatcgcaaggaacactcagatcattatacaggaagagtcagggatacctaaggttgccgatccctggggcggctcctacatgatggagtgcctaacaaatgacgtgtatgacgccgcactcaagctgatcaacgaaatagaagagatgggaggtatggcaaaagcagtagctgaaggcatacctaaattgcggatcgaggagtgcgccgcgaggaggcaagccagaatcgatagtggaagtgaggtaatcgtaggcgtgaataagtatcagctggagaaagaagacgccgtggaggttctagccatcgataacacctcagtgaggaaccgtcagattgaaaagcttaaaaagatcaaatcatcacgggatcaggctctagccgagcactgcctggccgcactgactgaatgcgcagcttctggcgatggaaatatcctggcactagcagtggacgcgtctcgggctcgatgtacagttggagaaataacagatgccttaaagaaagtatttggggaacataaagcaaacgataggatggtgagtggggcttaccgacaggagtttggcgaaagtaaagagatcacatcagctatcaaaagagtgcataagtttatggaacgcgagggacggaggcctcggttgctggtggccaaaatgggccaggatggccacgatcgcggggccaaggtcattgctactggctttgctgatttgggatttgacgtggacatcggtcctttgttccaaacgcccagagaggtggcccaacaggcggtggatgccgacgtgcacgcggtcggcatctctactctggcagcaggacacaaaaccctggtcccagagctgataaaggagctgaattcacttggccgccccgacatcctcgtgatgtgcgggggtgttattcctccccaagactacgagttcctgttcgaagtgggcgtcagcaatgtgtttggacctgggacgagaatacccaaggccgccgtgcaggttttggatgatatcgagaaatgcctagaaaagaagcaacagtcggtc

SEQ ID NO: 139 - DNA, 2250 bp, Artificial Sequence
  Codon optimized sequence that encodes an MCM polypeptide with the R532H mutation
atgctacgggccaagaatcagctttttctcttatcccctcactatctgcgacaggtaaaggagagctccgggtcacgcctgattcagcaacggttactccaccaacagcaaccgttgcatcctgagtgggccgcactcgcaaagaagcagctgaaagggaagaacccagaagacctcatatggcatacgcccgaaggaatctccatcaagcccctttacagcaagagagacacaatggatctgccggaagaattgcccggcgtgaagccttttactcggggaccatatccaactatgtatactttcagaccctggaccattcgccaatatgccggcttttctacagtggaggaaagtaacaagttttataaggataatataaaagccggacagcaggggctgagtgtggcctttgatcttgccacacacaggggctacgattcggacaatccccgcgtcaggggtgacgtgggaatggctggcgtggctatcgataccgtggaagacactaagattttgttcgacggaatcccactcgaaaagatgtcagtttctatgaccatgaacggcgccgtgatccctgtcttggcgaatttcatcgtaacaggcgaggagcagggtgtgccaaaggaaaagctcacagggaccatccagaacgacatcctcaaggaatttatggtgcggaatacatatattttcccaccagagcctagcatgaagatcatcgcagacatctttgagtataccgctaaacacatgcccaagtttaacagtatttccatttcaggctaccacatgcaggaagcgggagctgacgcaatccttgagttggcatatacgttggccgatggactggagtatagccgcaccgggcttcaggcaggccttacaatcgatgagttcgcacccaggttaagtttcttttggggtattgggatgaatttttacatggaaatagcaaagatgcgggccggcagacggctgtgggcgcatctgatagagaagatgttccagccgaagaacagtaaatcactgctgttgcgggctcactgccagaccagcggatggtctctgactgaacaagacccctacaacaatatcgtgagaactgccatcgaggctatggccgcagtctttggaggcacccagtctctacacacaaattctttcgacgaggccctcgggctgcccaccgtgaagagcgctcgtatcgcgcgtaatacccaaattattatccaagaggagtctggcattcctaaggtggccgacccttggggcggttcatatatgatggagtgcctcactaacgacgtctacgacgccgcactcaagctgattaatgagattgaggagatggggggcatggcaaaagctgtggccgaaggcatccccaaactcagaatagaagaatgcgccgccaggcgacaggctaggatagattcaggctccgaagtcattgtgggcgtgaacaaatatcaattggagaaggaggacgccgtagaggtgctcgcaatcgacaatacatccgttaggaacagacaaatcgaaaaactgaagaaaattaaaagctcacgcgatcaggctctggcagagcattgtctggccgctctgacagagtgcgccgcaagcggggatggcaacattctggcactggccgtggacgcaagccgcgctagatgtacggtcggggaaatcacagatgccctcaagaaagtgttcggagagcacaaagccaatgatcggatggtctctggagcctaccgacaagagttcggtgagagcaaagagattacaagcgcgattaagagggtgcacaagttcatggagcgtgagggacggcggccaaggctgctcgtggcgaagatgggacaggatgggcatgaccggggcgctaaagtgattgcaacagggtttgcagatctgggatttgatgtagacattggccccttattccaaaccccgagggaggtagcacagcaggcagtagatgccgatgtgcacgccgtggggatttccaccttggcagccggtcacaaaacgctagtgcctgagctgatcaaagaactcaatagtcttggaaggccagatatactggtcatgtgcgggggtgtgattccgccccaggattatgagttcctgttcgaggtaggtgtgagcaacgtgttcggccctgggactcggataccgaaggccgctgtgcaagtcctggacgatattgaaaagtgcctcgagaaaaagcagcagtccgtc

SEQ ID NO: 140 - DNA, 2250 bp, Artificial Sequence
  Codon optimized sequence that encodes an MCM polypeptide with the R532H mutation
atgctgcgcgctaagaatcagcttttcctgctcagccctcactatcttcgtcaggtaaaagagtctagcggttccaggctcatccagcagagattgttacaccagcagcagcctctgcaccctgaatgggccgcactcgcaaagaaacagctgaaaggaaagaacccggaagacctcatctggcatacaccagagggcatctcaatcaagccactttactccaaacgggatactatggacctccctgaggagctgcctggcgtaaagccctttactcgtggaccgtaccctacgatgtatacctttagaccatggaccatcaggcagtacgcaggctttagtactgtcgaggagagcaataaattttataaagataatatcaaggccgggcagcagggactctcagtcgcgtttgacctggccactcatcgcggttacgacagcgacaatcctcgagtgagaggggacgtgggcatggctggtgtcgcgatagacactgtggaagatacaaagatcctatttgacggaattcctcttgagaaaatgagtgtttcaatgacaatgaatggggcggtgatccctgtgcttgccaactttatcgttactggcgaagaacaaggcgttccaaaagagaaactgactggaaccattcaaaatgacattttaaaggaattcatggtccgaaatacttacatctttccacccgagccaagtatgaagattattgcagacatctttgagtatactgccaaacacatgcctaagttcaacagcatttctatctcagggtaccacatgcaggaggccggcgcagacgcaattctggagctggcgtatacacttgctgatggtctcgagtacagccgcacaggactgcaagccggtctgactatcgatgagttcgctcccagactctcttttttctggggaataggcatgaatttttatatggagatagcgaagatgagagccgggaggcggctatgggcgcacttgatcgaaaaaatgtttcaaccaaagaattcgaagtcgctcttgctgcgcgctcactgccaaacgtccggctggtcactgactgaacaggatccttacaacaacattgtcaggactgccattgaggcgatggcagcagtgtttggggggacccaatccttacacactaatagctttgacgaggcccttggactccccacggtgaagagtgcaaggattgctagaaatacccagattatcattcaggaggagtcaggcataccaaaagtcgcagacccctggggggggtcatacatgatggaatgcctcactaacgatgtctacgatgcagcgctgaagctcatcaacgaaattgaagaaatgggaggaatggccaaagccgtagcagaggggattcccaaactgaggatagaggaatgcgccgcccggcgccaggcgcgcattgacagcggctccgaagtgattgtcggcgttaacaaatatcagctcgaaaaagaggacgctgtggaggtccttgccatagataacacatcagtgcggaaccgccagattgagaagcttaaaaagataaagagctcacgggaccaggccctggccgagcactgtctggcggccctcaccgagtgcgccgccagcggggacggcaacatacttgccttagccgtggacgcctcgagagcaaggtgcacagtcggagagattaccgacgctcttaagaaggtcttcggagagcacaaggctaatgacagaatggtttctggcgcatataggcaggagtttggtgaatcaaaggaaatcacatctgcaatcaagagagttcacaagttcatggaacgggaggggcggaggcctcgactgctggtcgcaaaaatggggcaggacggccacgatcgcggggctaaggtgatcgccaccggcttcgccgacctggggtttgacgtggatattggaccactgtttcagacacctcgcgaggtggctcagcaggccgtggatgccgatgtgcatgccgtagggatctccaccctggccgccggacacaagacactcgtaccagagctgattaaagaactcaactcacttgggcgacccgacattctagtcatgtgtggtggagtgataccaccccaggactacgaatttctgtttgaagttggtgtgtctaatgtattcggccctggcacacgaattcctaaagctgctgtgcaggtgttggatgacatcgaaaagtgcctcgagaagaagcagcagtctgtt

SEQ ID NO: 141 - DNA, 2250 bp, Artificial Sequence
  Codon optimized sequence that encodes an MCM polypeptide with the T598A mutation
atgctccgggcaaagaatcagttatttctgttaagcccgcattacttgagacaagtgaaggagtccagcggatctcggttaatccagcaacgactgctgcaccagcaacagcctcttcaccctgaatgggctgcactggccaagaagcaattgaagggcaaaaaccccgaagacctgatttggcacaccccggagggaatctcgataaagcccttgtactccaagagggataccatggatctccccgaagaattgcctggcgtcaaaccgttcactcgggggccataccccaccatgtacacattccgcccttggacaatcagacaatatgccggattctctaccgtggaggaatccaacaaattctacaaagataatatcaaggctgggcagcagggactatcggttgcatttgacctggctacccaccgcgggtatgacagtgataaccccagagtaaggggagatgtcggcatggctggcgtggccatcgatactgttgaagacaccaaaatcctgttcgacgggattcctctcgaaaaaatgtctgtgtccatgactatgaacggcgcagttattcctgtgctggccaatttcattgtaacgggcgaggagcagggagtgccaaaggagaagcttacgggcaccatacagaacgacatcctaaaggagttcatggtgagaaatacttacatctttccccccgaaccctctatgaagattatcgctgacattttcgaatataccgccaaacacatgccgaaattcaactccatctccatttccggctaccacatgcaggaggccggcgccgatgccatcctagaactcgcctataccctcgcagacggattggaatacagtcgcactggcctccaagcaggactgacaatcgatgagtttgctcccagactttccttcttctggggcattggaatgaacttttatatggaaattgcaaaaatgagggccggcaggcgcctgtgggctcacctcattgaaaagatgttccagcccaaaaacagcaagtctttgttgttaagagcccattgtcaaacatctggatggagcctgaccgaacaggacccatacaataacattgttaggacggccattgaggccatggcggccgtattcggcggtacccaatccttacacaccaatagctttgacgaagccttgggcttgcctacagtgaagtctgccaggattgcgcgcaatacccagattataatccaggaggagagcggcattccaaaagtcgcagacccgtgggggggtagctatatgatggagtgtcttaccaacgacgtatacgatgctgctctgaagctcatcaacgaaatcgaagagatgggagggatggccaaggcagtcgccgaggggattcccaaattacggattgaagagtgtgccgcgaggaggcaggccagaattgatagtggatccgaggtgatcgttggggtgaataagtatcaacttgagaaagaggacgccgttgaggtgctcgccatcgacaatacatcagtcagaaacaggcaaatcgagaagctgaaaaagatcaaaagctcgcgagaccaggcactggccgaacgatgcttggccgctctcaccgagtgcgcggcctctggagatgggaatatcctcgccctcgctgtcgatgcatctcgtgcgcggtgcacagtgggtgagattaccgatgccctgaagaaagtgttcggggaacacaaggctaacgaccgaatggtttcaggagcctataggcaggagttcggcgagtcaaaggaaatagcttctgcgattaaacgtgtgcataagttcatggagagggagggacggcgccccagacttttagtcgccaagatgggtcaggatggccacgacaggggcgctaaggtgatcgctacaggcttcgcagacttagggttcgatgtcgacattggacccctttttcagactccacgggaagtagctcagcaggctgtcgatgccgacgtacatgccgtaggcattagtaccctggctgctggccacaagacactcgtcccagagctgattaaagaattaaacagtctcggccggcccgacatactggtcatgtgcggtggagtcatccctcctcaggattatgagttcttgttcgaagtgggggttagtaatgtgttcggcccaggcacacgaatccctaaggccgccgtgcaggttctggacgatattgaaaagtgcctggaaaagaagcaacagtcggtg

SEQ ID NO: 142 - DNA, 2250 bp, Artificial Sequence
  Codon optimized sequence that encodes an MCM polypeptide with the T598A mutation
atgctccgggctaaaaaccaactctttcttttgtctcctcactatctgcgacaggtcaaagagagctccggaagcagattgatccaacagcggctgctgcatcagcagcagccactacatccagaatgggccgctctggcaaagaagcagttgaaaggtaaaaatcctgaggatctgatatggcacaccccagagggtatatccattaaacccctttactctaagagagacacgatggacctccctgaagagttgcccggggtgaagcccttcactcgcgggccatatccaacaatgtacacattccgcccgtggacaatccggcagtatgccggattttccactgtggaagaatctaacaagttttataaggataatataaaggcgggccaacagggtctgtctgtggccttcgatctggccactcatcgcggctacgactcagacaatccaagagtgagaggcgacgtcggcatggctggtgtcgccatcgacactgtagaagataccaaaatcctcttcgacggaatacccctggaaaagatgtcagtttctatgactatgaatggcgccgtcatccctgtcctcgcaaacttcatagtgacaggagaagaacagggagtacctaaagagaagttaactgggacaatccagaatgatatcctgaaagagtttatggtacgcaatacttacatcttcccacctgagcccagtatgaagattatcgctgatattttcgaatatacagccaaacacatgccaaaattcaactctatctcaatcagtggctaccacatgcaggaggccggcgccgacgcaatccttgaactggcatacacgctggccgatggcctggaatatagtcggactggcctgcaggccgggctgactattgacgaatttgcaccccgtctgtcttttttttggggaatcggcatgaatttttacatggagatcgccaagatgagggctggcaggcgtctgtgggctcacctgatcgaaaagatgttccaacccaaaaattcgaagtccctgcttttaagggctcattgccagaccagtggctggtctctcaccgagcaagatccctataacaacatcgtgagaactgccattgaagccatggcagcagtattcggcggcacgcaaagtctccacacaaattcatttgatgaagccttggggttacccaccgtaaagagcgctcgcatcgcccggaatacccagattattattcaggaggagtcgggtatccctaaggtcgctgatccatggggaggctcttacatgatggaatgcctgacgaacgacgtttacgatgcagcactgaaactcattaatgagatcgaagagatgggaggtatggccaaggccgtggccgagggcatccctaaactgaggatagaggagtgtgctgcacgaaggcaggcacgtatcgactctggctctgaagttatcgtgggggtgaataagtatcagctcgagaaagaggacgccgtcgaagtgctggctatagacaatacctctgtacggaatagacaaattgagaaactcaagaagataaagagtagcagagaccaagctcttgcggagcgatgccttgccgctttgactgagtgcgccgcctctggcgacggaaacattctggctcttgcagtggacgcctcgcgggcccggtgcacagttggcgagattactgacgctttgaagaaagtctttggcgagcacaaagctaacgaccgaatggtgtccggagcctatcggcaagaatttggagagtccaaagaaattgccagcgccattaaaagagttcacaagtttatggaacgcgagggccgacgacctagattgctagttgcgaaaatgggtcaggacgggcatgatagaggggccaaggttatcgctaccggattcgctgacctcggtttcgacgttgatatcgggccattattccaaaccccacgggaggtggcccaacaagccgtagatgctgatgttcacgccgttgggatcagtaccctcgcagcaggtcataaaaccctggtacccgagctgattaaggagctgaattccttgggccgtccggacatactcgtcatgtgcggcggcgtaatcccaccccaggactatgagtttctgttcgaagtcggcgtcagcaatgttttcggcccgggcactcgcattccgaaagccgcagttcaggtgctcgacgacatcgaaaaatgcctggagaagaagcagcagtctgta

SEQ ID NO: 143 - DNA, 2250 bp, Artificial Sequence
  Codon optimized sequence that encodes an MCM polypeptide with the T598A mutation
atgctgcgcgccaaaaaccaactgttcctgctgtcacctcactacctccggcaagtgaaagagagcagtggttcaagactgatacagcaacggcttctccaccaacagcaaccactgcaccccgaatgggccgctctggctaagaaacagctcaagggcaagaatccagaggatctcatatggcatacccctgaaggcatcagcattaaacccctttatagcaagagggataccatggatcttcccgaggagcttcccggcgtaaagccctttacaagagggccttatcctaccatgtacacgtttaggccatggacaattaggcaatatgctggatttagtacagtggaagaatctaataaattctataaagacaatattaaggcaggccagcaaggtttgagtgtggcctttgatctggctacccaccgcggttacgatagtgacaaccctagggtacgcggagatgtcggtatggctggagtcgctatagatacggtcgaagatacaaaaattttgttcgacggaattcccctggagaagatgtctgtgagcatgacgatgaatggggctgtgatacccgttctggcaaacttcatcgtgaccggagaggagcaaggcgtcccgaaggaaaagctgaccgggaccatccagaatgacatcctcaaggaattcatggtaaggaatacctacatattccccccggagccttctatgaagatcattgcggacattttcgagtacactgcaaagcatatgccgaaatttaactccatttcaatttctggttaccacatgcaggaggccggcgccgatgcaattctggaactcgcttacactctcgccgatgggctcgaatacagtcggacaggactccaggcaggacttactatcgatgagttcgcacccaggctgagtttcttctggggaattgggatgaatttctatatggagatcgcaaagatgcgtgcgggtcggaggctgtgggcgcatcttattgaaaagatgttccagccaaaaaatagcaagtctctcttactcagggcccactgtcagacgtcagggtggtctttaacggagcaagatccttataacaacattgtcaggacggccatcgaggctatggccgcagtcttcggggggactcagtctctgcacacaaacagctttgacgaggccctgggtctaccaacggtcaaaagcgctagaatcgctcgcaatactcagattatcatccaagaagaaagtgggattcccaaggtagctgacccttggggggggtcgtacatgatggaatgtttgacaaacgacgtgtatgacgccgctctgaaactgattaacgaaatcgaagagatgggtggaatggctaaggctgttgcagaggggatcccaaaacttagaatcgaggaatgcgctgcgcgcagacaggctagaatagatagcgggtcagaggtgatagtgggggtgaacaaataccaactcgagaaagaagatgccgttgaagtgctggctatagataacactagtgtccggaacagacagatcgaaaaattgaaaaagataaaaagtagtagagatcaagccttggctgagcggtgcctggccgcactgacagaatgtgccgccagcggggatggcaacattctggccttagccgtggacgccagccgggctagatgtactgtaggggagattacagacgccctgaagaaagtgtttggagagcataaagccaatgacaggatggtgtcaggcgcctatagacaggaatttggggagagcaaagagatagcttctgccattaaacgtgtacacaaattcatggaaagagaggggcgccgcccgcgcttactggtggccaagatggggcaggacggacatgatcgaggtgccaaggtcatcgcaactggattcgcagatcttggatttgatgtggatattgggcctctcttccagactcctcgggaggtcgcccagcaggcggttgacgcagacgtacacgccgttggcatctcaactctggcggcgggacacaaaacacttgtccctgagctgatcaaggagctgaactccctgggaagacctgacattctggtcatgtgcggcggagtcattcctccccaggattacgagttcctgttcgaagttggagttagtaacgtgtttggccccggtacccgtatccctaaggccgcagtgcaggtactggacgacatcgagaagtgcttagagaagaagcagcagtctgtc

SEQ ID NO: 144 - DNA, 2250 bp, Artificial Sequence
  Codon optimized sequence that encodes an MCM polypeptide with the T598A mutation
atgcttagggcaaagaaccaactatttttgctgagtccgcattaccttaggcaggttaaggaaagtagtggctcccgtctgattcagcaaaggctactgcaccagcagcagccactgcaccctgagtgggccgcgttggcgaagaaacagctgaagggcaagaatccagaagaccttatatggcacacccccgagggcatctcaatcaaaccgttatattcgaagagggataccatggatttgcccgaggagctgcccggcgtcaagccctttactagggggccttatccgacaatgtacacattccgaccttggaccattcgtcagtacgcgggtttctctacagttgaagagagcaacaagttttataaggacaatatcaaggcgggccagcaggggctgagtgtcgcctttgatctcgctacacaccgaggatacgatagtgacaaccccagggttaggggcgatgttgggatggctggagtggccattgatacagtagaggatactaaaatcctctttgacggcatacccctggaaaaaatgagtgtctccatgactatgaatggagcagtaatcccagttttagcaaatttcattgttacgggagaggagcagggggtgcccaaagagaagctgactggcacaatccagaacgatatattaaaggaatttatggtgaggaatacgtacatcttccctcccgagccttcaatgaaaatcattgcagacattttcgagtacacagctaagcacatgcccaagttcaattccatttccatctcaggctaccacatgcaggaggcaggcgccgatgccatcttggagctggcctatacgttggccgacggcttggaatattcccgcaccggactccaggccgggctaaccattgatgaattcgccccaaggctgtcatttttctggggtatcggaatgaacttttacatggagatagctaagatgagagctggtcgacgcttgtgggctcatttgatagagaagatgttccaacctaaaaattccaagtctctcctgctgcgcgcccattgccagacttcgggttggtctctgaccgagcaggacccctacaataatattgtgaggacagcaattgaggccatggctgctgtttttggcgggacacagtcccttcacacaaactcatttgatgaggccctgggcctgcccaccgtgaagtcagcacgcattgcaagaaacacccagattatcatacaggaagaatccggtatccccaaggtcgccgacccgtggggcggtagctacatgatggagtgcttgacaaacgacgtatacgacgccgccctgaaactgattaacgaaattgaagagatgggcgggatggctaaggccgtagccgaaggtattcccaaactgagaatcgaagaatgcgccgctagaaggcaggcacgcatcgactccggttctgaggtcatcgtgggggtgaacaagtaccagcttgagaaggaggacgctgttgaggtcctggctatcgataacacgtcagtgagaaatagacaaatcgagaagctcaagaaaattaaatccagccgcgatcaggctcttgccgagaggtgccttgccgcactcacagagtgtgccgcctcaggcgacgggaatatattggcactggcggtggatgcaagcagagcgagatgcactgtcggtgaaatcacagacgcacttaagaaggtctttggggaacacaaggcaaacgatcgcatggtctccggggcctatcggcaggagtttggagaatcaaaggagattgcctccgccatcaagagagtgcataaattcatggaacgagagggtaggcggcctaggctgctggtggcaaagatgggccaggacggacatgatcggggtgccaaggttattgcgacgggctttgcggatctgggatttgatgtcgacatcggcccactctttcagactcctcgcgaggtcgcccagcaggctgtggatgcggacgttcacgctgtcgggatctcaacactcgctgccggccacaagacgttagtgcctgaattaattaaagaactgaatagcttaggccggccagacatattggtgatgtgcggtggcgtgattcctccccaggactatgaatttctctttgaggtgggggtctcgaatgtgttcggcccaggcaccaggatccctaaggctgcagttcaggtgctcgatgatatcgagaagtgcctagagaagaaacagcagtcggta

SEQ ID NO: 145 - DNA, 2250 bp, Artificial Sequence
  Codon optimized sequence that encodes an MCM polypeptide with the T598A mutation
atgttacgcgccaaaaatcagcttttcttactttcaccccattacctgcgccaggtcaaagaaagctccggatctcgacttatccagcaaagactacttcatcagcaacagccgttgcaccccgaatgggcagccctagcaaaaaagcagctcaaagggaaaaaccctgaggaccttatctggcatactcccgaaggaatctcaatcaagcccctctactctaaaagggataccatggatctgcccgaagagttgcctggggttaaacccttcactcgagggccataccccactatgtacacatttcgtccgtggactatccgacaatatgccgggttttctacggtagaagagagtaataagttttacaaagacaatattaaggccggtcagcaggggttaagcgtggcgttcgacttagctacgcatcgcggctatgactccgacaacccccgggttaggggggacgtgggcatggctggcgttgcaatcgataccgtggaagataccaaaattcttttcgacggaatacctttggagaaaatgagcgtctctatgaccatgaacggagcagtgattcccgtgcttgccaatttcatcgtcactggcgaagaacaaggggtgcccaaggaaaaattaactggcacaatccaaaacgacatcctgaaggaattcatggtgcggaacacctatatctttccacctgagcctagtatgaagatcatcgccgacatcttcgaatatactgctaagcatatgcccaagttcaacagtatttcaatatcgggatatcacatgcaggaggcaggtgccgacgccatcctggaactggcctacacattggctgacgggctggaatactccagaaccgggctgcaggcgggtctgaccatcgacgagtttgctcctcggttatcttttttctggggaatcggaatgaatttctatatggagatagctaaaatgcgcgccgggcgaagactctgggcccacctgatcgaaaaaatgttccagcccaaaaatagtaagagtctccttctccgggcgcactgtcagacttcaggatggtcgctcaccgagcaagatccatacaataatattgtccggaccgctatcgaggctatggcagcagtttttggcggaacccagtctctgcacacaaattccttcgatgaggctttgggactcccaacagtgaagagcgccagaatagcacggaacactcaaatcattatccaggaggaaagtggtatcccaaaagtcgcggatccatggggcggaagttacatgatggaatgcctcaccaatgacgtatacgacgccgccctcaagctgataaacgagatcgaggagatggggggtatggctaaggccgttgcagagggcattcctaaacttagaatcgaggaatgcgccgctagacggcaggcgagaattgactcaggttctgaggtgatcgtgggcgtgaacaagtatcaacttgaaaaggaggatgccgtggaagtgctggccatagataatacctccgtcaggaaccggcagatcgagaagttgaagaagatcaaaagcagccgggaccaggccttggctgaacgctgcctcgctgcactgaccgaatgcgctgcatctggcgacggaaatatcctcgcccttgcggtcgacgcatcgcgggctcgctgtacagtgggagaaatcactgacgcgctgaaaaaggtctttggtgagcacaaagcgaatgatcgaatggtgtccggagcttataggcaggagtttggtgagtctaaggaaatagccagtgcgattaagagagttcacaaatttatggagcgggaggggcgccgcccccgcctgctcgtcgcaaagatgggccaggacggccacgatcggggtgcgaaagtgatcgcgaccggcttcgccgatttgggctttgacgttgacatagggcccctgttccagacaccaagagaggtcgcgcagcaggcagtagacgccgatgtgcatgctgtcggtatcagtactctagctgctggacataaaaccttagtgcctgagctgatcaaggaacttaacagtctcggaaggcctgatatcctggtgatgtgtgggggtgtgatcccacctcaagactatgaattcctgttcgaagtcggcgtgtcaaacgtgtttggcccagggacgcggataccaaaagccgcagtgcaggtcctggatgacattgagaaatgtctggagaaaaagcagcagagtgtg

SEQ ID NO: 146 - DNA, 2250 bp, Artificial Sequence
  Codon optimized sequence that encodes an MCM polypeptide with the T598A mutation
atgctcagggccaaaaaccagctttttctcctctctccacattacctgcgacaggtgaaagaatcaagcggttcaaggctgatccagcagcgcctgcttcaccaacaacagccacttcacccggaatgggccgctctggccaagaaacaactcaaggggaaaaacccagaggacctcatctggcatactcccgagggaatctctattaagcctctttactccaagagggataccatggatctgcctgaagagctgccaggagtgaagccattcacccgaggaccttatccgacaatgtatacattccgcccttggacgatccggcagtacgctggcttcagtaccgtggaggagagcaacaagttctacaaggataacattaaggctggccagcagggactaagcgtagctttcgacctcgccactcataggggttacgacagcgacaatccgagagtcagaggggacgttggcatggctggcgtcgccatcgataccgtggaggataccaagattcttttcgatggaatcccactagaaaagatgtccgtgtcaatgacaatgaatggcgctgttatccctgtgcttgcaaacttcatcgtcacaggggaagaacagggggtgcctaaagagaagcttactggcacaatccagaacgacatactcaaagagtttatggttcggaatacctatattttccctcccgaaccttcgatgaagattatcgctgacattttcgagtatactgccaagcacatgcctaaatttaactccatctctattagcggctatcacatgcaagaggccggtgccgatgccatcctagagctggcctacactctcgccgacggcctggagtactcacgcactggtctgcaggctggcctaaccatcgatgaattcgcacccaggttgagttttttctggggaatcgggatgaatttctatatggagatagcaaagatgcgcgctgggcggagactgtgggcccacctgatcgaaaagatgtttcaacccaagaactcaaaaagcctattgctccgcgctcactgtcagacttctggatggagtttgactgagcaagacccgtataacaacattgtgagaacagcaattgaggccatggccgctgtcttcggaggcacacaatccctccatacaaattcctttgatgaggcgctcggcctcccaacggtgaagagtgcacgaattgcccgtaatactcagatcattattcaagaggagagtggaatcccaaaggtagcggacccctgggggggttcatacatgatggagtgtctcaccaacgacgtgtatgacgcagccctgaaactgatcaacgagatagaggagatgggaggaatggccaaggctgtggctgagggaatcccaaagctgagaatcgaagagtgcgccgcacgaagacaggccagaatcgacagcggttcagaagtgattgtgggagtgaacaaatatcagctcgagaaagaagatgccgtcgaggtcttggccattgacaatacttctgtgagaaatagacaaatcgagaaacttaagaaaatcaagtcaagtagggaccaggccctcgcggagcggtgtctcgcagccctgacggagtgcgccgccagcggcgacgggaacatcctcgcgctggccgtggatgcatccagagctcgctgtaccgtgggcgaaattactgatgcactcaaaaaggtctttggggaacacaaagcaaacgaccgcatggtctctggagcctaccgccaagagtttggcgagagcaaagagatagcatctgccatcaagagggtgcacaaattcatggagcgagaagggaggaggccccgcttgctcgttgcgaagatgggacaggatggccacgaccgtggcgctaaagtaattgccaccgggtttgccgaccttggctttgatgtggatatcgggccactgttccagactcctcgcgaggtagcccagcaggccgtggatgcggacgtccacgcagttggaattagcaccttggcggcgggccacaagactctggtacctgaacttatcaaggaactgaactctctgggtcgtccagatattctggtcatgtgcggcggggtgattcctccgcaggactacgaatttctatttgaggtcggggtttccaacgtctttgggccgggcactaggataccaaaggccgctgtccaggtgcttgacgatatcgagaaatgcctggagaagaagcagcagagtgta

SEQ ID NO: 147 - DNA, 2250 bp, Artificial Sequence
  Codon optimized sequence that encodes an MCM polypeptide with the T598A mutation
atgctgagggcaaagaatcagctgttcctgctgtcccctcactacctccgtcaagtgaaggagagctctggttcgcggttaattcagcagagactgcttcatcaacagcaacccctccaccccgaatgggctgccctggccaagaaacagctcaaaggtaagaaccctgaggacctgatctggcacacacctgaagggatcagcatcaagcctctctactccaagcgcgacactatggatctgccagaggagctccctggcgtaaaaccattcacccggggaccctatcctacaatgtacacctttcggccttggactatcagacagtacgctgggttctctacagtagaagagagcaataagttttacaaggataatataaaagctggtcagcagggcctcagtgtagccttcgacctagctacacacagaggatatgattccgataatccgagagttcggggagatgtcggcatggccggagtggcaatagacaccgtggaagatactaagatcctgttcgatggcattccgctcgaaaaaatgagtgtcagcatgactatgaacggcgctgtgatccccgtgcttgcaaactttatcgtaaccggggaggaacagggtgtgccaaaagagaaactcacaggaacaattcagaacgatattcttaaggagttcatggtcagaaacacatacattttcccacccgagccttcaatgaaaatcatcgccgacatattcgagtacaccgctaaacacatgccaaaatttaattcaattagtatcagtgggtatcatatgcaggaggcaggcgccgacgctattctggagctggcttacaccttggccgatggtctggaatattcacgcaccgggctgcaagctgggttgaccatcgacgaatttgcaccacgtctgtccttcttttggggaattggcatgaacttttacatggagattgcaaagatgcgggcaggacggaggctctgggcccatctcattgagaagatgtttcagcccaaaaactccaaatctttactgctgcgcgcccactgccagacttcgggctggtcgctgaccgaacaagatccttacaacaacatagttcggaccgcaatcgaagctatggctgccgtgttcgggggcacgcagtctctccacactaactccttcgacgaagccctaggtcttccaacagtgaagtccgctagaattgcccgaaatacccagatcattattcaagaggaatctggaatccctaaggtcgctgacccttggggcggtagctacatgatggagtgtctgaccaacgacgtgtacgatgccgcactaaagctcatcaatgagatagaagagatggggggaatggctaaagctgtagcagaaggcatccccaagctgcggatagaagaatgtgcggcacgcagacaagcccgcatagacagtgggtccgaagtgatcgtgggtgtaaataagtaccagctcgagaaagaggatgcggtggaggtactggccattgacaatacaagtgtcaggaaccgacagattgagaagctgaagaaaattaaatcctctagggaccaggccctggctgaaaggtgtctggcggcattgaccgaatgcgcagcaagcggcgacggaaacatactggcattggcggtagacgcaagccgtgctcgatgtactgttggcgaaatcactgatgcgctcaagaaggtttttggcgagcacaaggctaatgatcggatggtctctggggcctacagacaggaatttggagaatccaaggagatcgctagcgcaattaaaagagttcacaaatttatggagcgcgagggaaggagaccccggctgctcgtcgcaaagatgggccaagacggccatgatcgcggcgcaaaagtcatcgcaacgggctttgccgatctcgggtttgatgtcgatattggcccactgttccagacacccagggaagtggctcagcaagccgtcgatgccgatgttcacgccgtgggcatctcaacactagctgccggccataagacactagtaccagaactgatcaaggaactgaattctcttggtagacccgacatcctcgtgatgtgtggcggggttatcccgccgcaagactacgagtttctttttgaggtcggtgtgtcgaatgtcttcggacccggcactcggattcctaaagctgcagtgcaagtgttggacgacatcgagaagtgcctggaaaagaagcaacagagtgtt

SEQ ID NO: 148 - DNA, 2250 bp, Artificial Sequence
  Codon optimized sequence that encodes an MCM polypeptide with the T598A mutation
atgctgagagcaaaaaatcagctcttcctgctgtcaccccactatctgcgacaggtaaaagagtctagcggttccagactcattcagcaacgcttgcttcaccagcagcagccgctccaccctgaatgggcagccctggcaaagaagcagctaaaaggtaagaatccagaggatctgatctggcacacacccgaggggatctccattaagcccctatactctaagagagacactatggacttacctgaagaactgccaggtgtgaagccttttaccagagggccatatcctaccatgtatacattccgaccatggactatccgtcaatatgcggggttcagcaccgtagaggagtcaaacaaattttataaggataatatcaaagctggacagcagggcctgtccgtcgcattcgatctagcaacacacagaggatatgattcagacaatcctcgggtgcggggggacgtcggaatggcgggggtcgccatcgacaccgtggaggacaccaagatactcttcgatggcattcccctcgaaaaaatgtccgtgtctatgaccatgaacggcgcggtcattcctgtgctggctaactttatcgtaaccggagaagagcagggcgtgccaaaagaaaagctgactggaacaatccagaatgatatcttgaaagagttcatggtgcggaacacatacatcttcccaccggaaccttcaatgaagatcattgctgatattttcgaatacactgcaaaacacatgcccaaattcaatagcataagtataagcggatatcacatgcaggaggctggagccgacgccattcttgaactggcgtataccctggcggacggattggaatatagcagaacaggactacaggcagggttgaccatcgacgagttcgccccaaggctgagtttcttctggggaattgggatgaatttttacatggagattgccaagatgcgcgccggtcgtcgactctgggcacatcttatcgaaaagatgttccagcccaagaatagcaagtcactgctcctgagagcgcactgccaaacgtctggctggagcttgactgagcaggacccctacaataatatcgtgagaacggctatcgaagctatggccgctgtttttgggggcactcagtctctgcacacaaacagttttgatgaagcactcggcctcccaaccgtcaagtcagcaaggatcgccaggaacacccaaatcataatacaggaagagagcggcatccccaaagtggcagatccatgggggggaagctatatgatggaatgcttgacaaatgacgtgtacgatgcagccctgaaactgattaacgagattgaggaaatgggtgggatggctaaagccgtagccgagggcattccaaaactgcgcatagaggaatgtgcagctaggaggcaggctagaatagatagcggcagtgaggtcatcgttggtgtcaacaagtaccagctggaaaaggaagatgccgttgaggtcctggctattgacaacacctcggtcagaaatcggcagatagagaagctgaagaagataaagagtagtagagatcaagcccttgccgaacgttgcctcgccgccctgaccgagtgcgccgcttcaggcgatggaaatattcttgcacttgcagtggacgccagtagggctagatgtaccgtgggtgagatcacggacgctctcaagaaagtgtttggcgagcacaaggccaatgaccggatggtgtctggcgcgtatagacaggagttcggagaatcaaaagagatcgcctctgccattaagagggtgcacaaatttatggagagagagggccggcgcccccgactgttggtggcaaaaatgggacaggatggacatgacagaggcgcaaaagtcattgccaccggatttgccgatctgggctttgacgtggacattgggccgttgtttcagactccgagggaggtcgctcagcaggccgtggatgctgacgttcatgccgtgggaatcagcaccctggccgccggacataaaaccctcgtgccagagctgataaaagaacttaactccctgggccgtcctgatatcctggtgatgtgcggtggcgtaattccccctcaggattacgagttcctcttcgaggtgggcgtctccaatgtgtttggcccggggacccgtatcccgaaggccgcagttcaggtgttggatgacattgagaaatgcttagagaagaagcagcagagcgta

SEQ ID NO: 149 - DNA, 2250 bp, Artificial Sequence
  Codon optimized sequence that encodes an MCM polypeptide with the T598A mutation
atgctgcgggcaaagaaccaactcttcctcctaagcccgcattacctgaggcaggtcaaggagagttccggctctcgtttaattcaacagcggctgctgcaccagcagcagccattacaccctgagtgggcggcgctagcaaagaaacagttgaagggaaagaaccctgaggatctgatctggcacacccctgaggggatttccatcaagccactctattctaagcgggacactatggatcttccagaagaactgcccggcgtaaagcccttcacccgcggcccttaccctaccatgtacaccttccgaccttggaccatcaggcagtacgcaggattctcaactgtggaggaatctaacaaattttacaaggacaacataaaggccggacagcaggggttatctgtcgccttcgacctggccacacaccgagggtacgactctgataacccgagagtacgcggggacgtgggaatggctggagtcgcaatcgacacagtggaagacaccaagatcctgttcgatggcatcccactggaaaagatgagtgtcagcatgacaatgaatggagccgttattcctgtgctggctaactttatcgtgacgggagaggagcagggggtgccgaaggaaaagctgacgggtaccatccagaatgacatcctgaaggaattcatggtgcggaatacttatatttttcctccagagccatccatgaagatcatcgctgacatcttcgaatacaccgccaaacatatgccgaagtttaacagtatctctatctctgggtaccacatgcaggaggccggggcagacgctatcttagagttggcctatacacttgcagacgggcttgaatatagcaggactgggctgcaagccgggctgaccattgacgaatttgcgccccgcctgtcttttttttgggggattgggatgaacttctatatggagattgcaaaaatgagagctggcaggcgcctatgggcgcacctgatcgaaaagatgttccagccaaagaattctaagtctcttctcctgagagcccactgtcagaccagtggttggtccttaaccgagcaggacccatacaataatatagtacgtacagctattgaagccatggccgcggtgtttggcggaacacagagcctccacaccaacagctttgacgaggccctgggcttaccaaccgtcaaatccgcaaggatcgccaggaatacacagattattatacaggaggaaagtggcattcctaaggtggcagatccctggggcggttcttacatgatggaatgcctgacaaatgatgtctacgatgccgccttgaaactgatcaatgaaatcgaagagatgggtggcatggcaaaagctgttgcagagggaattcctaagctgcggattgaagaatgtgcagctcgccggcaggctagaatcgactccggtagcgaagtcattgttggagtcaacaagtaccagctagagaaagaggacgcagtcgaggtgctggccattgacaacactagcgtgcggaatagacagatcgagaagctgaaaaaaataaagtcctcacgcgatcaggcgctggcagaacggtgcttagcagctcttaccgagtgcgcagcctccggcgatggaaacatcctcgccctagcggtggacgcttcgcgtgcaaggtgcacagttggcgaaataacggacgcgctgaagaaagtattcggcgaacataaagctaatgataggatggtctcaggtgcatatagacaggagttcggggaatcaaaagaaattgcttccgcaattaaaagggtgcataaatttatggaacgagagggaagacggcctcgattactagtcgccaagatgggacaggatggccacgaccgaggggccaaggtcatcgctacggggttcgcagatctcggctttgatgttgatatcggaccactgttccagacccctcgagaggtcgcccagcaggccgtcgatgccgacgtccacgcagtgggcatatccacgctggcagctgggcataaaactctcgtccccgagcttatcaaagaactgaactcactgggccgacccgacattctggtgatgtgtgggggcgtaatcccacctcaggattacgagtttctttttgaagtgggagtaagcaacgtcttcgggccagggaccaggattccaaaggcggctgtccaggtgctggacgacatagagaagtgtttagaaaagaaacagcagagtgtt

SEQ ID NO: 150 - DNA, 2250 bp, Artificial Sequence
  Codon optimized sequence that encodes an MCM polypeptide with the T598A mutation
atgcttcgagccaagaatcagctcttcctcttgagcccacactatctgaggcaggtcaaggagtcatctgggtctcggttgattcagcaacgccttctgcaccagcagcagccgctccatcccgagtgggccgccctggccaaaaaacaactcaagggaaaaaatccagaggatttgatctggcatacacccgaagggatctccataaagcctttgtatagtaagcgcgacacaatggatctcccagaggagctgcctggtgtaaaacctttcaccagagggccctaccccaccatgtacacctttagaccgtggacaatcagacagtacgctgggttctcaacagtggaagagtccaacaagttttacaaagataacatcaaagcgggccagcaggggctcagcgtggccttcgacttagccacccaccgagggtatgacagcgataatccgcgtgttcgcggggatgtcgggatggccggcgtggccattgacaccgtggaagatacaaagatcctattcgatggaatcccactggaaaagatgagcgtctctatgactatgaacggagctgttatcccagttctggcaaacttcatagtaactggtgaagaacagggcgtgcctaaagagaagttgacagggactatccagaacgacatcttgaaggagttcatggtgaggaacacgtacatttttccacctgagccatcaatgaagattatcgctgacatattcgaatataccgcaaagcacatgcctaagttcaactcaatttccatctcaggctaccacatgcaggaggccggcgcggacgctattctggaattggcttataccctcgcggatggactcgaatattcgcggacaggcctccaagccgggttgaccatcgatgagtttgcacccagactcagcttcttttggggcatcggaatgaacttctatatggagatagcaaagatgagggcaggccggcggctgtgggcccatctgatcgagaagatgtttcaaccgaagaacagtaaaagccttctcctcagagcacactgccaaaccagcggttggtccttaacagaacaggatccttataacaatattgtgaggaccgccattgaggctatggccgcagtctttggcggtacgcagagcctccataccaatagctttgacgaagctcttgggcttcctacagtgaaaagcgcccggatcgcaaggaacacccagattatcatccaggaagagagtggcatacccaaagtggctgatccttggggaggaagctatatgatggagtgcctcaccaacgatgtgtacgatgcagccttgaagttgatcaacgagatcgaggaaatggggggcatggctaaggctgttgccgaaggtatcccaaaacttaggatcgaggaatgcgctgcacgccgtcaggctagaatcgacagtggtagcgaggtgatcgtgggcgtgaacaagtatcagctcgagaaagaagatgcagtcgaggtgttagcaatcgacaataccagcgtccggaaccgacagattgaaaaactaaagaaaattaagtcctcaagagatcaggccttggctgagagatgtcttgccgctctcacagagtgtgccgcttcaggggatggaaatattctcgcactggccgtggatgcctctagagctagatgtaccgtgggggaaatcaccgatgcattgaagaaggtctttggggagcacaaagcaaacgaccggatggttagcggcgcctatcgccaggagttcggcgaatcaaaggagattgcctcagccatcaaacgtgtacataaattcatggagagggaaggtcggcgcccacgtctcctggttgccaagatgggtcaggatggccatgaccggggggcgaaagtgatcgcaacgggctttgccgatttaggcttcgatgtggatatcggacccttgtttcagacccctcgtgaagtggcacaacaggccgttgacgccgatgtacacgccgtcggcatcagcaccctggccgcaggccacaagacactggtccccgagttaattaaggagctcaactcactcgggagaccagatattttggtgatgtgcggaggggtgattcccccgcaggattacgagtttctgttcgaggttggagtgtccaatgtgtttggccctggcaccaggattccaaaggccgccgtacaggtgcttgatgatatcgagaagtgcctggaaaagaagcaacaatcggtt

SEQ ID NO: 151 - DNA, 2250 bp, Artificial Sequence
  Codon optimized sequence that encodes an MCM polypeptide with the I671V mutation
atgctgagagccaagaaccagctgttcctgctgagccctcactacctgagacaggtaaaggagagcagcggctcaaggctgatccaacagaggttgctgcaccagcagcagccccttcatcccgagtgggcagctctggccaagaaacagttgaagggcaagaaccccgaggacctgatttggcatacccccgagggcatcagcatcaagcctctgtactccaagcgcgacaccatggacctccccgaggaactgcccggggtgaaaccatttacacgcggcccctaccccaccatgtacaccttccggccatggacgattaggcagtacgctggcttcagcacggtggaggagagcaataagttctacaaggacaacatcaaggcagggcagcaggggcttagcgtggcctttgacctggccacacaccgggggtacgacagcgacaatcccagggtgcggggcgacgttggcatggccggcgttgctatcgataccgtggaggatacgaagatactgtttgacgggatccccctggagaaaatgagcgtgagcatgacaatgaacggcgctgtgatccctgtcctcgctaacttcatcgttaccggcgaggaacagggagtacctaaggaaaagctgactggaactattcagaatgacattctcaaggaattcatggtcaggaacacttatatctttccccctgaaccgtctatgaaaatcatagcagacatttttgagtataccgccaagcacatgcccaagtttaacagcatctccatctctggctaccacatgcaggaggcaggcgccgacgctattctggagctggcgtacactctcgccgacggactggagtactctcgcactggactccaggccgggctgaccatcgatgagttcgcaccgaggctgtccttcttctggggcattggaatgaacttttacatggagatcgctaagatgcgagcaggccggagactgtgggcccacctgattgaaaaaatgttccaacctaagaattccaagagcctgctgttgagagcccactgccagaccagcggctggtcgctgaccgagcaggacccctacaataacatagtgcggaccgctattgaagccatggccgccgtttttggcggcactcagagcctgcacaccaacagctttgacgaggccctgggcctgcccactgtgaagagtgccagaatcgccaggaatacccagattatcattcaggaggagtcaggaatacccaaagtggccgacccctgggggggtagctacatgatggagtgcctgacaaacgacgtgtacgatgccgccctcaagctgatcaacgagatcgaggaaatgggcggcatggccaaggctgttgccgaaggcatccccaagctccggattgaagagtgtgcggccaggagacaggctaggatagacagcggcagcgaagtgatcgtcggcgttaacaaataccagctggaaaaggaagatgctgtggaggtgctggccatcgacaacacctccgttcggaacagacaaatcgagaagctgaagaaaatcaagagcagcagagaccaggcccttgctgagcgctgtctggccgcactaaccgaatgcgccgccagcggcgatgggaatatcctggccctggccgtggacgcttctagggcaagatgcacagtgggcgagatcacagacgctctgaagaaggtcttcggcgagcataaagccaacgaccggatggtgagcggagcataccggcaggagttcggcgagagcaaagaaattacctctgccatcaaacgcgtgcataagtttatggagcgggagggcaggagaccgcggctgttggtggccaaaatgggacaagatggccacgatcgcggtgccaaggtgatcgccaccgggttcgctgacctgggcttcgacgttgatataggccctcttttccagacacctcgggaggtggctcaacaggctgtggatgccgacgtccacgcagtgggcgtgagcaccctggccgccggccacaagaccctggtgcccgagttaatcaaggagttgaattcactgggcagacctgacatcctggtgatgtgcggcggcgtcatccccccgcaggattacgagttcctgttcgaggtgggagtgagcaacgtgttcggtcctggcacacggatccccaaggccgccgtccaggttctggacgacatcgagaagtgcctggaaaagaaacagcagtccgtg

SEQ ID NO: 152 - DNA, 2250 bp, Artificial Sequence
  Codon optimized sequence that encodes an MCM polypeptide with the I671V mutation
atgctgagagccaaaaatcagctcttcctactgagccctcattacctgaggcaggtgaaggagagctcagggagccggctcatccagcagagactgctccatcagcagcagccgctgcacccggagtgggccgccctggccaagaaacaactgaagggcaagaacccagaggaccttatttggcacaccccagagggcattagcatcaagcctctctatagcaagagagacaccatggacctccccgaggagctgcccggcgtgaagcctttcacccgtggcccctacccaaccatgtacacattcaggccctggactatccggcagtacgcgggcttctctaccgtggaggagtccaacaagttctacaaggacaatattaaagctggccagcagggactgagcgtggccttcgatttggccacccacagaggatacgacagcgacaaccccagggtgaggggcgacgttggaatggccggcgtggccattgatactgtcgaggacaccaagatcctgttcgatgggatacccctcgaaaaaatgtctgtgtccatgacaatgaatggggccgtgatcccagtgttggccaattttatcgtgacaggagaggagcagggcgtgcccaaggagaagctgaccggcaccatccagaacgacatcttgaaagaattcatggttagaaatacctacatctttcctcccgaacccagcatgaagatcatcgccgatatcttcgagtataccgccaaacacatgcccaaattcaactccattagcatatccggataccatatgcaggaggctggcgccgacgccatcctggagctggcgtacaccctggccgatggcctggaatattctaggaccggcctgcaggctggactcacaatcgatgagttcgccccccgcctgagcttcttctggggcatcggcatgaacttctacatggagatcgctaagatgagagcgggacgccgcctgtgggctcacctgatcgaaaaaatgttccaacctaagaatagcaagtctctgctcctgcgggcacactgtcaaacctccggctggtcccttacagaacaggacccgtacaacaacatcgtgagaaccgccatcgaagccatggcggccgtgttcgggggcacccagtcactccacaccaatagcttcgacgaggccctgggcttgcctactgtcaagtctgccaggatcgccaggaacactcagattatcatccaggaggagagcggcattcctaaggtagctgacccctgggggggaagctacatgatggaatgcctcaccaacgacgtgtacgatgccgccctgaagctgattaatgagatcgaggaaatggggggcatggccaaggctgtagccgagggaatccccaagctgagaatcgaggagtgcgccgccaggcggcaggcccgcatcgatagtggcagcgaggtgatcgtgggcgttaacaagtaccagctcgagaaggaagacgccgtagaggtgttggcaatcgacaatacctccgtgagaaataggcagatcgagaagctaaagaagataaagagcagccgggaccaggctctggcagaacggtgcctggccgccctcactgaatgcgccgcttctggcgatggcaacattctggcccttgccgtcgatgccagccgggcccgatgcactgtgggagagatcacagacgctctgaagaaggtgttcggcgagcataaagcaaacgatagaatggtgtccggcgcctacaggcaggagtttggcgagagcaaggagatcacatctgctattaagagagtgcataagttcatggagagagagggacggcggcctagactgctggtagcaaagatgggccaggacggccacgatcggggagcaaaggtcattgctaccgggttcgccgacctgggcttcgacgtggacattggccccctcttccagaccccccgcgaagttgctcagcaggctgtggatgctgacgtgcacgctgtgggcgtcagcacactggccgctggacataagaccctggttcccgagctgatcaaggagctgaatagcctgggtcggccagacatcctcgtgatgtgcgggggtgtgatcccccctcaggattacgagttcctgttcgaggttggagtctctaatgtgttcggccccggaacaagaatcccgaaggccgctgtgcaagtcctggacgacatcgaaaagtgcctcgagaagaagcagcagtctgtg

SEQ ID NO: 153 - DNA, 2250 bp, Artificial Sequence
  Codon optimized sequence that encodes an MCM polypeptide with the I671V mutation
atgctgagggccaagaaccagctgttcctcctgtctcctcactacctgagacaggtgaaggagtccagcggtagcagactgatccagcagaggctgcttcaccagcagcagcccctccatccggagtgggctgcactggcaaaaaagcagcttaagggaaaaaaccccgaggacctgatttggcacaccccagagggaattagcattaaacccctctacagcaaacgggacacgatggacctgcccgaggaactgcccggcgtgaagcccttcacacggggcccataccccacaatgtatacattccgtccttggaccattcgccaatacgccgggttcagcacggtggaggaatccaacaagttctacaaggacaacatcaaggccggccagcaaggcctcagcgtcgcctttgacttggccacccacagaggctacgactccgacaaccccagagtgagaggcgacgtgggtatggccggcgtggccatcgacactgttgaggacaccaaaatcctatttgacggcatacccctggaaaagatgtccgtgagcatgacaatgaatggcgctgtgatccccgtgctcgctaacttcatcgtgaccggcgaggagcagggtgtccctaaggagaaacttaccggcacaatccagaacgacattctcaaggagtttatggtgcgcaacacctacattttccccccagagcctagcatgaagatcattgccgacatcttcgagtacaccgccaagcatatgccaaagtttaactccatttcaatctctggctaccatatgcaggaagctggcgctgacgccatcttagagctggcctacaccttggccgacggcctcgaatacagcaggaccggccttcaggccggtctgaccattgacgaatttgcacccagactgagcttcttctggggcatcggcatgaacttctatatggagatcgctaaaatgagagccggccggagactgtgggctcacctgatcgagaaaatgtttcaacccaagaactccaaaagccttctgctcagggcccattgtcaaacctctggatggagcctgactgagcaggacccgtataacaacatcgtcaggaccgccatcgaggccatggctgcggtgtttggcggaacccagtccttacacacaaatagctttgacgaagccctggggctgccaaccgtgaaaagcgccagaatcgcccggaatactcagataatcatccaggaggagtccgggatccccaaggttgccgacccctgggggggaagttacatgatggagtgcttgaccaacgatgtgtacgatgctgctctgaagctgattaacgagattgaggagatgggaggcatggctaaggctgtcgcggagggcatccctaagctgagaatcgaggagtgcgccgcccgccggcaggccaggattgacagcggatctgaggtgatcgtgggggtgaacaagtaccagctggagaaggaggacgccgttgaggttctggctatcgacaacaccagcgtcagaaacaggcagatcgagaagctgaagaaaatcaaaagcagcagagaccaggccctggcagaaagatgcctggctgccctgaccgagtgcgctgctagcggagacgggaacatcctggctctggccgtcgacgcttccagagccaggtgtaccgtcggcgagatcaccgacgccctgaagaaagtgttcggcgagcacaaggccaacgaccgcatggtgtccggcgcctacaggcaggagttcggcgagtccaaggagattacctccgccatcaaacgggtgcacaaattcatggagagagagggcagacggccacgcttgctcgtggccaagatggggcaggacggccacgataggggcgctaaggttatcgctacaggctttgctgatctgggcttcgacgtggacatcggccccctgtttcagacccctagagaggtagctcagcaggccgtcgacgccgacgtgcacgccgtgggcgtcagcacactggcagccggacacaagaccctcgtgcccgagcttatcaaggaactgaactccttggggcggcccgacatcctcgtcatgtgcggcggagtgattcccccccaggactatgagttcctgttcgaggtcggcgtaagcaacgtctttggccccggaactcggatccccaaggccgcagtacaggtgctggacgacatcgaaaagtgcctggagaagaagcaacagtctgtg

SEQ ID NO: 154 - DNA, 2250 bp, Artificial Sequence
  Codon optimized sequence that encodes an MCM polypeptide with the I671V mutation
atgctgcgcgctaaaaaccaactattcctgctgtccccccattacctgagacaggtgaaggagagctccggaagcaggctgatccaacagagacttctgcaccagcagcagcccctgcatcccgagtgggccgctctggctaagaaacaactgaagggaaagaaccccgaggacctgatctggcacaccccagagggcatatccatcaagcccctgtattctaagagggacactatggacctgcccgaggagctccccggcgtcaagcctttcacacgcggaccttaccccacaatgtacacattccgaccatggaccattaggcagtacgcaggattcagcaccgttgaggagtccaataaattctataaggacaatattaaggccggacaacagggcctgagtgtggcattcgacctggccacacacagaggttacgactccgataatcctagggtgagaggcgacgtgggcatggctggagtggccatcgataccgtcgaggacacaaagatcctgttcgacggcatccccttggagaaaatgtccgtgagcatgaccatgaacggcgccgtgattcccgtgctggccaactttattgtaaccggcgaggagcagggcgtccccaaggagaagctgaccggcaccatccagaacgatatcctcaaggagttcatggtacggaatacctacatttttccccccgaaccctccatgaagatcatcgccgacatcttcgagtacaccgccaagcacatgcccaagttcaactccatcagtattagcggctatcacatgcaggaggccggcgccgacgccatcctggaactggcctacacactggccgacggtctggagtacagcagaaccggcctgcaagcaggcctgaccatcgacgagttcgcccctcgactgagcttcttctggggcattggcatgaacttttacatggagatcgccaaaatgcgcgctggcaggcgactctgggcccacctgatagaaaaaatgttccagcccaagaactccaagtccctgctcctcagggcccactgtcagactagcggctggagcctcaccgagcaggacccatataataacattgtaagaacagccatcgaggccatggccgcagtgttcggagggacccagagcctgcataccaacagcttcgatgaggccctgggactgcccactgtaaagtccgctagaatagcccggaacacccagatcattatccaggaagagtccgggatccccaaggtggccgacccatggggcggcagctacatgatggagtgtctcaccaacgacgtttacgatgctgccctgaagcttatcaacgaaatcgaggagatgggcggcatggccaaagccgtcgccgaggggattccaaagctccggatcgaggagtgcgccgccagaaggcaggccagaatcgactctggaagcgaggtgattgtgggtgtgaataagtatcagcttgagaaggaagacgctgtagaggtgctggctatagataacaccagcgtcaggaacaggcagattgaaaagctgaagaagatcaagtcgagcagagatcaggcgctggccgagagatgcctggccgccctgactgagtgcgccgcctctggcgatggcaacatcctcgcactggccgtggacgctagccgggcccggtgtaccgtgggcgagataaccgatgccctgaagaaggtgttcggagagcacaaggccaacgacagaatggtgtctggcgcatatagacaggagttcggcgagagcaaggagattacgagcgccatcaagagagtgcacaagttcatggagagggagggcaggagaccacggctgctggttgccaagatgggccaagacggtcacgacagaggggctaaagtgattgccaccggcttcgccgacctgggcttcgacgtggacatcggtccactgttccagacccctagggaggtggcgcagcaggccgtggacgccgacgtgcacgccgtcggcgtgagcacactggctgccggccacaagacactagttcctgagctgatcaaggaactcaacagcctgggccggcctgatatactggtgatgtgcgggggggtgatcccccctcaggattacgagtttctgtttgaggtgggcgtgtccaacgtcttcggccccgggaccagaatcccaaaggccgcagtgcaggtattagacgacattgagaagtgcctggagaagaaacagcagtccgtt

SEQ ID NO: 155 - DNA, 2250 bp, Artificial Sequence
  Codon optimized sequence that encodes an MCM polypeptide with the I671V mutation
atgctacgagctaagaatcagctcttcctgctgagcccccactacctccgccaggtcaaggagtcgtcggggagccggctcattcagcagcggctcctgcaccagcagcagccgctccatccggagtgggccgccctggccaagaagcagctcaagggcaagaaccccgaggacctgatctggcacacacccgagggcatctcgatcaagcccctgtattccaagcgagataccatggacttgcccgaggagctgcccggtgtgaagccctttacgaggggtccatatccgactatgtacacgtttcggccttggaccatccgacaatacgccggcttttccaccgtggaggagagcaacaagttctataaggacaatatcaaagccggtcaacaagggctgtcggtcgcgttcgacctggccacccacaggggttacgactccgataatcccagggttcggggggacgtcggcatggccggcgtggcaatcgacaccgtggaggataccaagattcttttcgatggcatccccctcgagaagatgtctgtctccatgactatgaacggcgccgtgattcccgtcctggcgaacttcatcgtcaccggggaggaacagggtgtgcccaaggagaagctgactggtaccatccagaacgatatcctaaaagaattcatggtccggaatacctacatatttccgcccgagcccagcatgaagatcatcgccgacatcttcgagtataccgccaagcacatgcccaagttcaactcgatcagtatcagcggttatcacatgcaggaggcgggagcagacgccatcctggagctggcgtacaccctggccgacggcctggagtacagtcgcacaggactgcaggctgggctgacaattgacgagtttgcccccaggctctcctttttctggggcatcggcatgaacttttatatggagatagccaagatgagggccgggaggaggctgtgggcccatctaattgaaaagatgttccaacctaaaaactccaaatccctcctgctgcgggcccactgtcagactagcgggtggagcctcacggagcaagacccttacaataacatcgtccgcaccgccattgaggcgatggccgccgtgttcggcgggacgcaatctctgcacaccaacagcttcgacgaagcgctgggcctgccaaccgtaaagagcgcccgtatagcgcggaacacccagatcataatccaggaggagtcgggcatccccaaggtggccgacccctgggggggcagttatatgatggagtgcctgacgaatgatgtctacgacgcggcactgaaactcatcaacgagatcgaggagatgggggggatggccaaggctgtcgccgagggcataccgaagctgcggatcgaagagtgtgccgcccggcggcaggcgaggatcgacagcgggtccgaggtgatcgtgggcgtgaacaaatatcagctcgagaaagaggacgccgtcgaggtactggcaatcgacaacaccagcgtgcggaaccgtcagatcgaaaagctcaaaaagattaagagctccagggaccaagccctggccgaacggtgcctggccgcgctgaccgaatgcgctgccagcggtgatggcaacattctcgccctggctgtcgatgcaagcagggcccgatgcacagtgggcgagatcaccgacgcgttgaagaaggtttttggagaacataaagccaacgataggatggtgtcaggagcttacaggcaggagtttggcgagtcaaaagagatcaccagcgccatcaagcgcgtgcacaagttcatggagcgggagggccggcggcctcggctcctggtagcaaaaatgggccaggacggtcacgataggggcgccaaagtgatcgccaccggttttgccgatctgggtttcgatgtcgatattggcccgctgttccaaaccccccgggaggtggcccagcaggccgtcgatgcggacgtgcacgcggtgggagtgtccacgctggcggcaggccacaagaccctggtgcccgagctgatcaaagagctgaacagcctgggtcgcccggatatcctggtgatgtgcgggggggtaatcccccctcaggattacgagttcctgtttgaagtgggggtgtcaaacgttttcgggcccggcacccggatccccaaggcggccgtccaggtgctcgatgatattgagaagtgtctggagaagaagcagcagtcagta

SEQ ID NO: 156 - DNA, 2250 bp, Artificial Sequence
  Codon optimized sequence that encodes an MCM polypeptide with the I671V mutation
atgctgcgggccaagaaccagctctttctcctgtcccctcattacctgaggcaggtgaaggagagcagcggcagccgcctcatccagcaaaggctgctccaccagcagcagccactgcaccccgagtgggccgcactggccaagaagcagctcaagggcaagaatcccgaggacctgatctggcacacgccagaaggaatctccatcaagcccctgtattcgaaaagggacacgatggacctcccagaagagctgcccggcgtgaagccctttacccgaggtccctaccccaccatgtacaccttccggccctggaccatccggcagtatgccgggttctccaccgtggaggagagcaataaattttacaaggataacataaaggcagggcaacagggcttaagcgtggcctttgacctggcgacccacaggggctacgattcagacaacccgcgtgttaggggggacgtgggcatggccggggtcgccatcgacaccgtggaggacaccaaaatcctcttcgacggtatacccctggagaaaatgtccgtgtccatgaccatgaacggggcggtgatccccgtgctggcgaatttcatcgtcaccggagaggagcaaggggtgccgaaggagaagctgaccggcacgatacaaaacgatattctgaaagagttcatggtccggaacacctacatttttcccccggagccctccatgaagatcattgcggatatattcgagtataccgccaaacacatgcccaagttcaacagcatcagcatcagcggttaccacatgcaagaggccggagccgacgctatcctggagcttgcctacaccctggccgacggcctggagtacagccgtacaggcctgcaggcgggcctcaccatagatgagttcgcccccaggctatcctttttctgggggatcggaatgaacttctatatggagatcgccaagatgcgggccggccggcggctgtgggcccatctgatagagaaaatgttccagcccaagaattcgaaaagcctgcttctgcgggcacactgccagaccagcgggtggagcctgacagagcaggacccgtacaacaacatagtccgcactgccatcgaggccatggccgccgtcttcggtgggacgcagagcctgcacacaaactcattcgacgaggctctgggtctgcccaccgtgaaaagcgcccgcatcgcacgcaatacgcagatcatcatccaggaggaatccggcatccctaaggtggcggacccctggggcggtagctacatgatggaatgcctgaccaacgacgtctacgacgcggcgctcaagctgataaacgagattgaggaaatgggggggatggcgaaggcggtggctgagggaatacccaaactgcgcattgaggagtgcgccgcccgaaggcaggcgcggatcgatagtgggtccgaggtcatcgtgggcgtaaacaagtaccagctcgagaaggaagacgccgtggaggtgctggccatcgacaatacgtcggtgcgcaatcgccaaatagagaagctgaaaaagatcaagagcagccgagaccaggccctggccgagcgctgtctggcggccctcaccgaatgtgccgcctcgggcgatggaaatatcctcgcgctcgccgtggatgcctcccgggccaggtgcactgtgggcgaaatcacggacgccctcaaaaaggtgtttggcgagcacaaggccaatgatcggatggtgtccggcgcgtaccgccaggagttcggggaaagtaaggagattacctccgcgatcaaaagggtgcacaaattcatggagcgggagggccggcggccccgccttttagttgccaaaatggggcaggacgggcacgaccggggcgctaaggtgatcgccaccggcttcgccgacctgggcttcgatgtggacatagggcccctcttccaaaccccgagggaggtggcgcagcaggcggtggacgccgatgtccacgcggtcggcgtcagcaccctggcggcggggcataagacactcgtgccagagctcatcaaggaactgaatagcctggggaggcctgatattctcgtaatgtgcggtggtgtgatccccccgcaggactacgaattccttttcgaagtcggggtgagcaacgtgttcgggcccggcaccagaatcccaaaggcggcggtccaagtgctcgacgatatcgaaaagtgcctagaaaagaagcagcaatcggtt

SEQ ID NO: 157 - DNA, 2250 bp, Artificial Sequence
  Codon optimized sequence that encodes an MCM polypeptide with the I671V mutation
atgctgcgcgcgaagaaccagctgtttctcctgagcccacactacctgcgtcaggtgaaggagagctccggctcacggctgatccaacagaggctgctgcaccagcagcagccccttcaccccgagtgggccgcactagccaagaagcaactcaagggtaaaaacccggaggacctcatctggcatacccccgaggggatcagcatcaagcccctgtactcgaagcgggatactatggacctgcccgaagagctccctggagtgaaaccctttactcgagggccttatcctactatgtacacctttcgcccgtggactatcaggcagtacgccggcttcagcaccgtggaagagtccaataagttttacaaggacaatataaaggccgggcagcagggtctcagcgtcgccttcgacttagccacccaccgcggctacgatagcgacaaccctcgggtacggggagacgtgggaatggccggcgtagccatcgataccgtggaggacacaaagatcctcttcgacggaataccgctcgaaaagatgtcagtgtctatgaccatgaacggggcggtcatcccagtactggcaaatttcatcgtgacgggagaggagcagggcgtgcccaaagaaaagctgaccggcacgatacaaaacgacatcctgaaggagtttatggtgcgcaacacctacatcttcccgcccgagccctcgatgaagatcatcgcggacatcttcgagtacaccgccaagcacatgcccaagtttaacagcatcagcatatccgggtaccatatgcaggaggccggcgccgacgccatcctcgaactggcctataccctcgccgacggactggagtacagccggaccggactgcaggccgggctgacaatagacgagtttgcaccccggctctccttcttctgggggatcgggatgaacttttatatggagatcgccaaaatgcgtgccggtcggcgcctgtgggcgcatctcatcgaaaaaatgtttcagccaaagaacagcaaaagcctgctgctgcgagcccactgtcaaaccagcgggtggagcctgacggagcaggacccttataacaacattgtgcgaaccgccatcgaagccatggccgcggtgttcgggggcacccagtccctgcacaccaactccttcgacgaggccctcggactccccaccgtcaagtccgcgcgcatagcgcggaatacccaaatcatcatccaggaggagagcggtatcccgaaagtggccgacccttggggcggaagctacatgatggagtgcctgactaacgacgtgtacgatgccgccctgaagctgataaacgaaatcgaggagatgggtggcatggcgaaggccgtcgcggaagggatccccaagctgcggatcgaagaatgcgcagccaggcgccaggcccggatcgactccgggtccgaggtgatcgtgggcgtgaacaagtatcagctggagaaggaagatgccgtggaggtgctggccatcgacaacacctccgtgcggaacagacaaattgaaaaactcaaaaaaatcaagagcagccgcgaccaggccctcgccgaaaggtgcctggcggcgctgactgaatgcgccgcgtcgggagacgggaacatactggccctggctgtcgacgcctccagggcccggtgtaccgtcggcgaaataacggatgcgctaaagaaggtcttcggggagcataaagcgaacgaccggatggtgagcggcgcataccgacaggagttcggagagagcaaggagatcacatcagccatcaagcgcgtccataagtttatggaacgcgaaggccggcggccccgactgctggtcgcgaagatggggcaggacggccacgacagaggggccaaggtcatagccacgggctttgcggacctggggtttgacgtggacatagggcccttattccagaccccgcgggaggtggcccagcaggccgtggatgcggacgtacatgctgtcggggtgtcaacgctggcagccgggcacaagaccctggtgcccgagctcattaaagagctgaacagtctgggtaggccggacatcctcgtcatgtgcggcggagtgatcccgccccaggactacgagttcctcttcgaggtgggtgtctcaaacgtctttggccccggcacccgcatccccaaggccgccgtacaggtccttgacgacattgagaagtgtctcgagaaaaagcagcagtccgtt

SEQ ID NO: 158 - DNA, 2250 bp, Artificial Sequence
  Codon optimized sequence that encodes an MCM polypeptide with the I671V mutation
atgctgcgcgctaaaaaccagctctttctcctgtcaccgcactacctgagacaggtgaaagagtcgagtggctcaagactgatccaacaaaggctgctgcaccagcagcagcccctgcaccccgagtgggcggccctcgccaagaaacaacttaagggcaagaaccccgaggacctcatctggcatactcccgaggggatctcgataaagcccctctattcaaagagggataccatggacctgccagaggagcttcctggcgtgaaaccattcacgcggggcccataccctaccatgtacacattccggccgtggactatccgccaatatgccggattcagtaccgtcgaggagagcaataaattctacaaagacaacatcaaggcggggcagcaggggctgtccgtggccttcgatctggctacccaccgcgggtacgattccgataacccccgtgttcgcggggatgtcgggatggctggcgtagctatcgacaccgtggaggataccaagatcctgttcgacggtatccccctagaaaagatgtccgtgagcatgaccatgaatggcgccgtcatccctgtactggccaatttcatcgtcaccggggaggagcagggggtgcccaaggagaagctcacgggcaccatacagaacgacattctgaaggagtttatggtgcgaaacacctacatattcccccccgaaccgtccatgaaaatcatcgctgatatctttgagtacacggccaagcacatgcctaagttcaacagcatctccatatccggctaccatatgcaggaggccggagctgacgccatactggaactggcctatacactggccgacggactggagtatagccggaccggcctgcaagccgggctcaccatcgacgagttcgcaccgcgactaagcttcttctggggcatcggcatgaacttctacatggagatagccaagatgcgcgcaggtcgcaggctctgggcccatcttatcgaaaagatgttccaacccaagaactccaaaagcctcctgctccgcgcgcactgtcagaccagcggctggtcactgacggagcaggatccatacaacaacatcgtgcgcacggccatcgaggccatggcagctgtattcgggggcacccagtccctgcacaccaactcctttgacgaggccctgggcctccccaccgtcaagagcgcgcgtattgcgcgcaacacccagatcatcatccaagaagagtccggtattcctaaggtggccgacccctggggcggctcgtacatgatggagtgcctgaccaacgacgtgtacgacgccgccctgaagctgatcaatgagatcgaggagatgggtgggatggccaaggctgtcgccgaaggcatcccgaagctgcgcatagaagagtgcgcagcccgacggcaggcacggatcgactccgggtccgaggtgatagtgggcgttaataagtaccagctggagaaggaggacgctgttgaagtcctggccatcgacaacacctctgtgcgtaacaggcagatcgaaaagctcaagaagatcaagtccagccgcgaccaggccctggccgagcggtgcctggctgccctgaccgagtgtgccgcgtcaggggatggcaacatcctcgccctggccgtcgacgcctcccgcgccaggtgtaccgtcggggaaatcaccgacgccctgaagaaggtatttggcgagcacaaagccaacgataggatggtaagcggcgcctacaggcaggagttcggggaatccaaagagatcacctccgccatcaagcgggtccacaagttcatggaaagagagggccgtagacctcgactgctggtggccaagatgggccaggatggtcatgatcggggcgccaaagtgatcgcgaccgggttcgccgatctgggattcgacgtggacatcggccccctcttccagacgcccagggaggtagcgcagcaagccgtggatgccgacgtgcacgcggtgggcgtgtccaccctcgcggccggtcacaagaccctcgtgcccgaactcatcaaggagctgaacagcctggggcggcccgacatcctggtcatgtgtggaggcgtcattccaccccaggactatgagtttctcttcgaggtcggcgtgtcaaacgtgtttggccccggcactaggatacccaaagcggcagtccaggtcctcgacgatatcgagaagtgtctcgagaagaagcaacagtccgtg

SEQ ID NO: 159 - DNA, 2250 bp, Artificial Sequence
  Codon optimized sequence that encodes an MCM polypeptide with the I671V mutation
atgctccgtgccaagaaccagctgttcctgctgagcccccactatctccgacaggtgaaagagtcgtccggaagcaggctgatccagcaaagactgctgcaccaacagcaaccactgcatcccgagtgggccgcgctggccaagaagcagctgaagggcaagaaccccgaagatctcatctggcacacacccgagggcatcagcatcaagcccctgtattccaagagggataccatggacctgccagaagagctgcccggcgtcaagcctttcacacgaggcccctacccgaccatgtacaccttcaggccctggacgatccgacaatatgccggcttcagcaccgtggaggagagcaacaaattttacaaggacaacatcaaggccgggcaacaaggcctatccgtcgccttcgacctggcgacccaccgggggtacgacagcgataacccccgcgtgcgtggagacgtgggaatggcgggggtagctattgacacggtagaggatacaaagatcctgtttgatgggatcccgctggaaaagatgagcgtgtccatgacgatgaacggggccgtgattcccgtcctggccaatttcatcgtcacgggtgaagaacaaggcgtacccaaagaaaagctgaccggtaccatccaaaacgatatcctgaaagagttcatggtgaggaatacctacatctttccccctgaacccagcatgaagatcatcgccgacatcttcgagtataccgccaaacacatgcccaagttcaatagtatcagcatctcaggctatcacatgcaggaagccggggccgacgcgatactggagctggcctataccctggccgatggcttggaatatagccggacggggctccaggccggcctcaccatcgacgaattcgcccccaggctgagcttcttctgggggatcgggatgaacttctacatggagatcgccaagatgcgggcggggcggaggttgtgggcccatctcatagagaaaatgtttcagcccaagaactcgaagtccctcctgctccgggcacattgccagaccagcgggtggtctctcaccgagcaggatccctataataacatcgtgcgcaccgccatcgaggccatggccgccgtcttcggtggcacccagagcctccacacaaactccttcgacgaagcccttggcctgcccaccgtgaagagcgcacggatcgcccggaacacccagatcatcatccaggaagagtcagggatccccaaggtggcggatccctggggcggcagctatatgatggagtgtctgaccaacgacgtttatgatgccgccctcaagctcatcaatgagattgaggagatggggggtatggccaaggcagtggcggagggaatacctaagctccgcattgaagagtgtgccgcccggcggcaagcccggatagactccggcagcgaggtgatcgtgggcgtgaacaagtatcaactggagaaggaggacgccgtggaggtcctggccattgataacacctccgtgaggaacagacagatcgagaagctcaagaagatcaagtcaagccgtgaccaggccctcgccgaacgctgtctggctgccctcaccgaatgcgccgccagcggcgacgggaacatcctggccctggcagtggacgccagcagagccaggtgcaccgtgggcgaaataaccgacgccctgaagaaggtgttcggcgagcacaaagctaacgatcggatggtctcgggggcctaccgccaggaattcggggagtccaaggagatcacgagtgccatcaaaagagtccataaattcatggagcgcgaggggaggcgacccaggctgttggtcgctaaaatggggcaggacggccacgacaggggcgccaaagtcattgcgaccgggtttgccgacctgggcttcgacgtggacatcgggccgctgttccaaaccccccgtgaggtcgcccagcaggcggtggacgccgatgtgcacgccgtgggggtgagcacactcgccgccggtcataagacgttggtgccagagctgataaaggagctgaactccctcgggcggccagatatactggtgatgtgtgggggcgtgatacccccacaggactacgagttcctgttcgaagtgggggtaagcaacgtgttcggcccagggaccaggataccgaaggcggcggtccaggtgctggacgacattgaaaaatgtttggaaaagaagcaacagtccgtc

SEQ ID NO: 160 - DNA, 2250 bp, Artificial Sequence
  Codon optimized sequence that encodes an MCM polypeptide with the I671V mutation
atgctgcgggccaagaatcagctgtttctgctgagcccccactacctgcgtcaagttaaggaaagttcaggatccaggctgatccagcagaggctgctgcaccagcagcagccgctgcatccggagtgggccgcgcttgccaaaaagcaactgaaggggaagaatcccgaggacctgatctggcatacccctgaggggatctcaattaagccactgtactccaagcgggataccatggacctccccgaggagctgcccggggtcaaacccttcacccggggtccctaccccaccatgtacactttccgaccctggaccatcagacaatacgccggcttctccaccgtggaggagagcaacaagttctataaagacaatatcaaggcaggacagcagggcctctccgtggcctttgacctcgccacgcacaggggttatgatagcgacaacccccgcgtgcgaggcgatgttgggatggccggcgtggcgattgacaccgtggaagacacgaagatactctttgacggcatccccctcgagaagatgtccgtaagcatgacaatgaacggcgcggtcatccccgtgctggccaacttcattgttactggcgaggagcagggggtcccgaaagagaaactgaccgggaccatacagaacgacatactcaaagagtttatggtccgcaatacatatatcttcccccccgagccctcaatgaagatcatagcggacatctttgaatacacggccaagcacatgccaaagttcaatagcatcagcatctccggctatcacatgcaggaggcgggtgccgacgccatcctggaactcgcctataccctggcggacggcctggagtacagccgcacggggctccaggcgggtctgaccatcgacgaattcgccccccggctgtccttcttttgggggatcggtatgaatttttacatggagatcgccaaaatgcgcgccgggcgcaggctgtgggcccatctgatcgaaaagatgtttcagcccaagaacagcaagtcgctgctgctgcgggctcattgccagacatcgggatggtccctcactgagcaagatccctacaacaacattgtgcgcacagcgatcgaggcaatggccgcagtgttcgggggtacccagtccctccacacaaactccttcgacgaggccctggggctaccgacggtcaaaagcgcccgaatcgcgcgcaacacccagatcataatccaggaggaaagcggtatccccaaggtggcagatccgtggggcggtagctatatgatggagtgcctgaccaacgacgtctatgacgctgcactgaagctcatcaacgaaatcgaagagatgggtggcatggccaaagccgtagccgagggaatcccaaagcttcgaatcgaggagtgcgctgccaggagacaggcccgcatcgattcaggtagcgaggtgatcgttggggtgaataagtaccagctcgagaaggaggacgccgtggaagtgctggccatagacaacactagcgtacgcaacaggcagattgagaagctgaagaaaatcaagtcgagccgagaccaggccctcgccgaaaggtgcctggccgcattgaccgaatgcgccgccagcggcgacgggaacatcctcgccctggctgtggacgccagcagggccaggtgcacggtgggggagatcacggatgctctcaaaaaggtgtttggtgagcacaaggctaatgaccggatggtgtcgggcgcctatcggcaagagttcggcgaaagcaaagagatcaccagcgccatcaagcgagtgcacaagttcatggaacgcgagggcaggaggcccaggctgctggtggccaagatggggcaggacggccacgaccgaggtgccaaagtgatcgccactgggttcgcggacctgggcttcgatgtggacattggccccctctttcagaccccccgagaggtggcccagcaggccgtcgacgccgatgtgcatgcggtcggcgtgagcaccctcgctgccggtcataaaaccctcgtgcctgagctgatcaaggaactgaactcactggggcggcccgacatcctggtcatgtgtggaggagtgatcccgccgcaggactacgagttcctatttgaggtaggcgtgagcaacgtctttgggccgggaaccaggatcccaaaggctgcagtgcaggtgctcgacgatatagaaaagtgcctcgaaaaaaaacagcagtccgtg

SEQ ID NO: 161 - DNA, 2250 bp, Artificial Sequence
  Codon optimized sequence that encodes an MCM polypeptide with the I671V mutation
atgctgagagcgaaaaaccagctctttctgctgagcccccactatctgcggcaagtcaaggagtcctccggctccaggctgatacagcagcgcttactccatcagcagcagcccctgcacccggagtgggccgcgctggctaaaaaacagctgaaggggaagaaccccgaggacctcatatggcacaccccggagggtatcagcatcaagccgctgtactccaagcgggatacgatggatctccccgaggagctgccaggtgtgaaacctttcacacgggggccgtatcccaccatgtacacctttcggccttggacaatccggcaatacgccgggttttcaactgtcgaggagtctaacaagttttacaaggacaacatcaaggcaggccaacagggcctcagcgtcgccttcgatctggccacccacagggggtacgattccgacaaccccagggtgcgcggggacgtgggcatggccggcgtggccatcgacaccgtcgaagatacgaagatcctgttcgacgggatcccgctcgaaaagatgagcgtgtcgatgaccatgaacggggccgtgatcccagtgctcgccaatttcattgttaccggggaagagcagggcgtgccaaaagaaaaactcacgggaactatccaaaacgacatcctgaaagagttcatggtaaggaacacctatatcttcccccccgagcccagcatgaagatcatcgcggatatctttgagtataccgccaagcatatgcccaagttcaattcgatcagcatcagcgggtaccacatgcaggaggcaggcgccgacgccatcctggagctggcgtacacgctggccgatggactggagtactcccggaccgggctgcaggccggcctcaccatcgacgagttcgccccacggctatcctttttttgggggatcggtatgaatttctatatggagatcgccaagatgcgcgccggtcggaggctctgggcccacctgatcgagaagatgttccagccgaaaaactccaaatccctgctgctccgggcccactgccagacgtccggttggtccctgactgagcaagatccgtataataacatcgtgcgcaccgccatcgaggcgatggccgccgtcttcgggggtacccagtccctccacaccaattccttcgacgaagccctgggcctccccaccgtgaagtccgcacgtatcgcacggaacacccagataatcatccaggaggagagcgggatccccaaggtagccgatccttggggcggatcctacatgatggagtgcctgaccaacgacgtctacgacgcggccctgaagctgatcaacgaaatcgaggagatgggcggcatggcaaaggccgtcgccgaggggatccccaagctgcgaatcgaagaatgcgccgcaagaaggcaggctcggatcgattccgggagcgaagtgatcgtaggggtgaataaatatcagctggaaaaggaggatgccgtcgaggtcctggccatcgataacacctccgtccggaatcgtcagatcgaaaaactgaagaagatcaagtcgagccgcgaccaagccctggcagagcgttgcctcgccgcactgaccgaatgtgcggccagcggcgacgggaacatcctggccttagccgtggacgcctcccgtgcccggtgcacggtgggcgagatcacggacgccctcaaaaaggtcttcggagagcacaaagccaatgacaggatggtgtcgggggcctacaggcaagagttcggcgaatccaaggagatcacaagtgccatcaagcgcgtacataaattcatggagcgcgaaggtcgtcgcccccggctgctggttgccaagatgggacaggacggccacgatagaggggcgaaagtcattgccaccggattcgccgacctggggtttgacgtggacatcggtcctctgtttcagaccccccgcgaagtggcccagcaggccgtcgatgccgatgtgcacgcggtgggggtgagcactctggccgccggccacaagaccctggtacccgagctcatcaaggagctgaactccttggggcggcccgacatcctggtgatgtgcgggggagtcatcccgcctcaggactacgagttcctcttcgaggtgggcgtcagtaacgtgttcgggcctggtactcgcattcccaaggcggcggtccaggtactggacgatatcgaaaagtgcctcgaaaagaagcagcagtcggtg

SEQ ID NO: 162 - DNA, 2250 bp, Artificial Sequence
  Codon optimized sequence that encodes an MCM polypeptide with the I671V mutation
atgctgagagccaaaaaccaactgtttctcctcagcccacactatttgcggcaggtgaaagagtcgtcgggttctcgcctcattcagcaacgtctgctgcaccagcagcagccgctgcaccccgagtgggccgccctggcgaagaagcagctgaagggcaagaaccccgaggacctgatctggcacaccccggaaggtatcagcataaagccgctctactccaagcgggataccatggacctgcccgaggaacttcccggcgtgaagccctttacccgcggtccctacccgacgatgtataccttccgtccatggactatacgtcaatatgcgggcttcagcaccgtggaggagagtaacaagttttacaaggacaatatcaaggcgggccagcaaggcctgtcagtggcctttgacctcgccacccacagggggtacgacagcgacaatcctcgagtgcgtggcgacgtcggcatggcgggtgtcgccatcgacaccgtggaggatacaaagatccttttcgacgggatccccctcgaaaagatgtccgtgagcatgaccatgaacggggcagttatacccgtgctggctaacttcatcgtgacaggagaggaacaaggggtacccaaggaaaagctgaccgggaccatccagaatgacatcctgaaggagttcatggtgaggaacacctatattttcccacccgagccctccatgaagatcatagccgacatatttgagtataccgccaagcacatgcccaagtttaacagtatatccatcagcgggtatcacatgcaagaggccggagcggacgccattctcgagctcgcctacacgctggcggacggcctggaatactcccgtacggggctgcaagcggggctgaccatcgatgagttcgccccccgcctgtccttcttttggggaatcggtatgaacttctacatggagatcgccaagatgcgcgccgggagacggctgtgggcccacctcatcgagaagatgttccaacccaagaacagcaagtccctgctgctccgggctcactgtcagacttccggctggtccttgactgaacaggacccgtacaacaacatcgtgagaacggccatagaggccatggccgccgtgtttggcggaacccaatcgctccacaccaactctttcgacgaggccctgggcctcccaacggtcaaatccgcccgcatcgccaggaacacccaaatcatcatccaagaagagagcggcatccccaaggtggccgatccctggggcggcagctatatgatggagtgtcttaccaacgatgtgtacgatgccgccctgaagttgatcaatgaaatcgaagagatgggcgggatggccaaagccgtggccgaggggatccccaagctgcggatagaggagtgcgcggcaaggcggcaggcccggatagacagcgggagcgaagtgatcgtgggcgtgaacaaataccagctggaaaaggaagacgcagtagaggtcctcgcaattgacaacaccagcgtgagaaaccgccagatagagaagctcaaaaagatcaagtcctcacgggaccaggccctcgccgagcggtgcctggccgctctgaccgagtgtgccgcgtccggtgatggcaacatccttgccctcgcagtggatgcctcccgggcaagatgtacagtgggggagataacggacgccctgaagaaagtgtttggggaacataaagccaacgaccgcatggtcagcggggcctataggcaagagttcggggaatccaaggagatcacctccgccattaaacgggtgcacaagtttatggagagggagggccggaggccccgactcctggtggccaagatggggcaagacggacacgacaggggcgctaaggtcatagccaccgggttcgccgacctggggttcgatgtagacattggccccctgtttcagaccccccgcgaggtggcgcagcaggccgtggacgccgacgtccatgccgtgggtgtcagcaccctcgcggccgggcataagacactggtgcccgagctgatcaaggagctaaatagcctcgggagaccggatattctcgtgatgtgcggaggggtcataccgccccaggactacgagttcctctttgaggtgggcgtgtcaaacgtcttcggccccgggacccggatccccaaggccgccgtgcaggtgctggacgacatcgaaaagtgcctggagaaaaagcagcagagtgtc

SEQ ID NO: 163 - DNA, 2250 bp, Artificial Sequence
  Codon optimized sequence that encodes an MCM polypeptide with the I671V mutation
atgctgcgagcgaagaaccagctctttctgctgagcccccattacctaaggcaggtgaaggaaagctccggcagccgcctgatccagcagcggcttctgcaccaacaacagccactccacccggagtgggccgccctggccaagaagcaactgaaggggaagaaccccgaggacctaatctggcataccccggaaggcatctccatcaagcctctgtactccaagagagacaccatggacctgcccgaagagctccccggcgtgaagccctttaccaggggcccctatcccaccatgtacaccttccgtccgtggacaatccgccagtatgccggtttcagcaccgtcgaggagtccaacaaattctacaaggacaacatcaaggccgggcaacaggggctcagcgtggccttcgatctggccacccaccggggctatgacagcgacaacccgcgagtgcggggagatgtcggcatggccggcgtggctatcgacaccgtcgaggacaccaagatcttgtttgacgggatcccgctggagaaaatgagcgtctcaatgacgatgaatggagccgtgatccccgtgctggccaacttcatcgtcaccggtgaggagcagggcgtgcccaaagagaagctaaccggcaccatccagaacgatatactcaaggagttcatggtgcggaacacatatatcttcccccccgagccctccatgaagataatcgcggacatttttgagtacacggcgaagcacatgcccaagttcaatagcataagcatctccggctaccacatgcaggaggccggagccgatgccatcctcgaacttgcgtatacccttgccgacggcctggagtactcccgtaccggcctccaggccgggctgaccatcgatgaattcgcgcctcgtctgtccttcttctggggtatcggcatgaacttctatatggagatcgccaagatgagggccggccggcggctgtgggcccacctgatcgagaagatgttccaacccaagaactccaagtccctgctgctgcgggcccactgccagaccagcggctggagcctgacagagcaggacccgtacaacaacatcgtcaggacggccattgaggccatggccgccgtgttcggaggcacgcagagcctgcataccaactcgttcgacgaagccctgggcctgccaaccgttaaatccgcccgaattgcccgtaatacccagatcattatccaggaagagagcggcatccctaaagtggcggacccctggggcgggagctacatgatggaatgcctcaccaacgacgtctatgacgccgccctgaagctcatcaatgagatagaggaaatgggggggatggccaaggccgtcgcagaaggtatccccaagctccggatagaggagtgcgcggccaggcgccaagcccgtattgattccggttccgaagttattgtcggagtgaataaataccagctggagaaagaggacgccgtggaggtgctggccatcgataatacctcggtccgcaataggcagatcgagaagctgaagaagatcaagagctcccgggaccaggccctggctgagcggtgcctcgccgccctgacggagtgcgccgccagcggtgacggcaacatcctggctctggccgtggatgcctcccgcgcccgatgcacggtgggggagatcaccgacgcactgaagaaggttttcggcgagcacaaggccaatgaccgcatggtgagcggggcctaccgacaggagttcggcgaatcaaaagagatcacgagcgcgatcaagcgggtccacaagttcatggagcgagaagggaggaggccgcggctccttgtggcgaagatgggccaggatgggcatgatcggggagccaaggtgatcgccaccgggttcgccgacctcggcttcgatgtcgatatcgggcctctatttcagaccccaagagaggtggcccagcaggccgtcgatgcggatgtgcatgccgtgggtgtgagcactttggccgccggccataagacgctggtgcccgagctgatcaaggagctgaattccctcggcaggccagatatcctggtgatgtgcggcggggtgatccctccacaggactacgagttcctgtttgaggtgggcgtgtctaatgtcttcgggccgggcaccaggataccaaaggccgcagtacaggttctcgacgatatcgagaagtgccttgagaagaaacaacagtccgtc

SEQ ID NO: 164 - DNA, 2250 bp, Artificial Sequence
  Codon optimized sequence that encodes an MCM polypeptide with the I671V mutation
atgctacgcgccaaaaaccagctgttcctcctcagtccgcattacctcaggcaggtcaaagagtccagcggatcccggctcatccagcagcgtctactccaccaacagcagccactgcacccggagtgggcggccctcgctaaaaagcagctgaagggtaagaacccagaagatctgatctggcacacgcctgagggaatctccattaaaccgctctactccaaacgcgacaccatggatctgcccgaggagctgccgggggtgaaacccttcaccagggggccctacccgaccatgtacacctttcggccgtggaccataaggcaatacgccggtttctcgaccgtggaggagagcaacaagttctataaggacaacattaaggcagggcaacaggggctgagcgtggccttcgacctggccacccatcggggatacgattccgataatccccgggtccggggcgacgtgggaatggccggcgtggccatcgacacggtggaggacaccaaaatcctctttgacggcatcccgctggagaagatgtccgtgtccatgaccatgaatggggccgtaatccccgtgctcgcgaacttcatagtcacgggcgaggagcagggcgtgccgaaggagaaactcacaggcactatccaaaacgacatcctgaaggagttcatggtgcggaacacctacatcttcccgcccgagccgagcatgaagataattgcggatatcttcgaatacaccgccaagcatatgcccaagtttaattccatttcaatcagcggctatcatatgcaggaggccggggcggatgccatcctggagctggcctatactctcgccgacggcctggaatacagcaggaccggcctgcaggcggggctgacgatcgacgagttcgctcccaggctgagctttttttgggggatcgggatgaacttttatatggagatcgccaaaatgcgagctggccgccgcctgtgggcccatctcatcgagaagatgttccagcccaagaactccaagagtctcctgctgcgcgcgcactgccagacctccgggtggagcctcaccgaacaggacccctacaacaacatagtccggaccgcgatcgaagccatggcggccgtgtttggaggcacgcaaagtctgcacaccaacagcttcgacgaggccctgggcctgccaaccgtgaagagcgcccgcatcgccagaaatacccagatcattatacaggaggagagcggaattcccaaggtcgcggacccctggggaggttcctatatgatggagtgcctgaccaacgatgtgtacgacgccgctcttaagctgattaacgagatcgaggagatgggcgggatggccaaagcggtggccgagggaatacccaagctgcgcatcgaggaatgcgccgcccgccgtcaagcacggatcgacagtggctccgaagtgatcgtgggtgtgaacaagtaccagctggagaaggaggatgccgtggaggtgctggccatcgacaacacctccgtgaggaaccgccagatagagaaactgaagaagatcaagagctccagggaccaggccctcgccgagcggtgcctggcagcactgaccgaatgtgccgcgagcggggacgggaacatcctggccctggccgtggatgcatcccgggcccgctgcaccgtcggtgagatcactgatgccctgaagaaggttttcggggagcacaaggctaacgaccgcatggtgtccggggcgtacagacaggagtttggcgagtcaaaggaaattaccagcgccatcaagcgggtgcacaaattcatggagcgcgaaggtcgccgacctaggctgctcgtcgccaagatgggtcaggacgggcatgaccgcggcgccaaggtcatcgcgaccgggtttgccgaccttgggtttgacgtcgacatcggacccctgtttcagacccccagggaagtggcccagcaagccgtcgatgcggacgtgcatgccgtcggagtgagcaccctcgcggccgggcacaagaccctggtgcccgagctcatcaaggaactgaacagccttgggcggcccgacatcctcgtgatgtgcggcggggtgatcccgcctcaggactacgagttcctatttgaggtaggggtgtccaatgtctttggccccgggacaaggatccccaaggccgctgtccaggtcctggatgacatcgagaaatgcctggaaaagaagcagcagtccgtc

SEQ ID NO: 165 - DNA, 2250 bp, Artificial Sequence
  Codon optimized sequence that encodes an MCM polypeptide with the I671V mutation
atgctgagggctaagaaccagctgttcctgctctccccccactacctgaggcaggttaaagaatcctccggaagcaggctgatacagcagagactcctgcatcagcagcagcctctacaccccgagtgggccgccctggccaaaaagcagttgaaaggcaaaaatcccgaagatctgatctggcacacccctgaaggcatcagcatcaagccactgtacagcaagagagacaccatggacctgcccgaggagttgccaggcgtgaagccttttaccagaggcccctaccccacaatgtataccttccggccctggacaattagacagtacgcaggcttcagcaccgtggaggagtccaataagttttacaaggacaacatcaaggctgggcagcaggggctctcagtggccttcgatctggctacccatagaggctatgatagcgataatcccagagtgagaggcgacgtaggaatggccggcgtggccatagataccgtggaggatacgaaaatcctcttcgacggcatccctctggaaaagatgtctgtgagcatgaccatgaacggcgcagtgattcctgttctggccaacttcatcgtcacaggggaagagcaaggcgtgcccaaagagaagctcacgggcaccatccagaatgacattctgaaagagttcatggtgagaaacacttacatcttcccacccgaaccttcaatgaagatcatcgccgacatcttcgagtatacagccaaacacatgcctaagttcaatagcatcagcatctccggataccatatgcaggaggctggcgctgacgccattctggagctggcctacaccctggcagacggtctggagtacagcagaacaggtcttcaggccggtctgaccattgacgagtttgccccaaggctgtccttcttctggggaatcggcatgaacttctacatggagatcgccaagatgagagccggtagaagactgtgggcccacctgatcgagaagatgttccagcctaagaattccaagagcctgctgctgcgcgcccactgccaaacctctggctggtcattaaccgagcaggatccttacaataacatcgtgcgaaccgccatcgaagccatggctgctgttttcgggggaacccagtccttgcacacaaacagcttcgacgaggccctgggcctgcccaccgtgaagagcgccaggattgcccgaaacacgcagatcatcatacaggaggagtctggcattcccaaggtggccgatccttggggcgggtcttatatgatggaatgcctgacaaatgacgtctacgacgccgccctgaagctcatcaacgagatcgaagagatgggcgggatggccaaagctgtagccgagggcatccctaagctgagaattgaggaatgcgccgctagacggcaggcaaggattgacagcggcagcgaggtcattgtgggcgtcaacaaataccagctggagaaggaagacgccgtggaggtgctggccattgacaacacatctgtgagaaaccggcaaatcgaaaagctgaaaaaaatcaagtcctccagagatcaggctctggctgaaagatgcctggccgccctgaccgagtgtgccgcgagcggcgatggcaacatcctggctctggccgtggacgcaagcagagctagatgtacagtcggcgagattaccgatgcgctgaagaaggtgttcggcgaacacaaggccaacgatcggatggtgagcggcgcttatcgccaggagttcggagagtccaaggagatcacctccgcaataaagagggtgcacaagtttatggagcgcgagggaagacggccccgactgctggtggccaagatgggccaagatggccatgacagaggggccaaggtgattgccaccggctttgcagatctgggcttcgatgtggacatcggccccctgttccaaacccctagagaggtggcccagcaagccgtcgacgctgacgttcatgccgtgggcgtctccaccctggcggcaggacacaagacactggtgcctgagctgatcaaggaactgaatagcctcgggagacccgatatcctggtgatgtgcggaggcgtgatcccccctcaggactacgaatttctgttcgaggtgggcgtctcgaatgtgttcggacccggcacaagaattcccaaggctgctgtccaggtcctggacgacattgagaaatgcctggagaagaagcagcagtccgtg

SEQ ID NO: 166 - DNA, 2250 bp, Artificial Sequence
  Codon optimized sequence that encodes an MCM polypeptide with the I671V mutation
atgctgcgcgccaagaaccagctgttcctgctgagcccccactacctgagacaagtgaaggagagcagcggcagcagactgatccagcagaggctgctccaccagcaacagcccctgcatcccgagtgggctgctctcgctaagaaacagctgaagggcaagaaccccgaggacctgatctggcacacacctgagggcatatcaatcaaacccctctattcgaagcgagacaccatggacctgcccgaggaattacctggcgtgaaaccattcaccagaggcccttatcccaccatgtacacttttaggccatggacaattcggcagtacgcaggcttttccactgtggaagagagcaataagttttacaaagataacattaaggccggtcagcagggcctgagtgtggcatttgacctggctacccacagaggctatgacagcgacaaccccagagtgagaggcgacgtgggcatggccggcgtcgctatcgacaccgttgaagacacgaagattctgttcgacggcatccccctggagaagatgagcgtttccatgaccatgaacggcgctgtgatccccgtgctggccaatttcatcgtgacaggagaggagcagggcgtgcctaaggagaagttgactggcaccatccagaatgacatcctgaaggaattcatggtgcggaacacctacatcttcccccctgaacctagcatgaaaatcatcgctgacatctttgagtacacagccaagcacatgccgaagttcaacagtatcagcatctctggctatcacatgcaggaggcaggcgctgacgccattcttgaactcgcctacaccctggccgacggcctagagtactccagaacagggctgcaggctggcctgactatcgacgagtttgcccctcgcctgagctttttttggggcattggaatgaatttctatatggagatcgccaagatgcgcgctggaagaagactctgggcccaccttatcgagaagatgtttcagccaaaaaatagcaagtccctgctgctgagggcccactgccagacctctggctggagccttactgagcaggacccctacaacaacattgtgcggaccgccattgaggctatggccgctgtgttcggcgggacccagagcctgcacaccaatagtttcgacgaggccctgggattgcccacggtgaaatccgctcggatcgcccggaacacacagatcatcattcaggaggaaagcggcatccctaaggtggccgacccatggggcggcagctatatgatggaatgtctgaccaatgacgtgtacgacgccgctctgaaactaattaacgagatagaggaaatgggcggcatggctaaggccgtggccgagggcatccctaagttgcgtatcgaagaatgcgccgcccgtagacaggccaggatcgacagcggctcagaggtgatcgttggagtgaacaaatatcagcttgagaaggaggacgccgtggaagttcttgccattgacaacactagcgtccgtaacagacagatcgagaaactgaaaaagatcaagtcgagtagagaccaggctctggccgagaggtgcctggcagctcttactgaatgcgccgctagcggagacggaaacattctggccctggccgtcgacgcctcccgggccaggtgcaccgtgggagaaatcactgacgccctgaagaaggtcttcggcgaacacaaggctaacgaccggatggtgtcaggcgcgtacagacaggagtttggcgaatccaaggagatcacgagcgccatcaagagagtgcataaattcatggagcgggagggtaggaggcccagactgcttgtggccaagatgggccaggacggccatgatagaggagctaaagtaatagctacaggcttcgctgatctgggcttcgatgtggatatcggccccctgttccagaccccaagagaggtggcccagcaggcagtggatgcagacgtgcatgcggtgggcgtgagcaccctcgccgccggtcacaagacactggtgcccgagctgatcaaggagctgaatagcctgggccggcccgatatcctcgtgatgtgcggaggcgtgattccccctcaagactacgaattcctgttcgaggttggagtgtctaatgtgtttggcccaggcaccagaatccccaaagctgccgttcaggtcctcgatgacattgaaaaatgcttagagaagaagcagcagagcgtg

SEQ ID NO: 167 - DNA, 2250 bp, Artificial Sequence
  Codon optimized sequence that encodes an MCM polypeptide with the I671V mutation
atgctgagggctaagaaccagctgtttctgctttctccccactacctccgccaggttaaggagtcctctggaagcaggctcatccagcaaagactgcttcaccagcagcagccactgcaccctgagtgggccgccctggctaaaaagcagctgaagggcaagaaccccgaggatctgatttggcacacgcccgagggcatctccatcaagcctctgtactccaagagagataccatggacctgcccgaggaactccctggcgtcaagccattcacacggggcccctaccccacaatgtacacattccggccttggacgattaggcagtatgctgggttctctacagtagaggagtccaacaaattctataaggacaacatcaaggccggacagcaaggcctttctgttgccttcgacctcgctacccaccgcggctatgatagcgataatcccagagtgaggggcgacgtgggcatggccggggtggctattgacaccgtggaggatactaagatcctgtttgacggcatccctctggagaagatgagcgtgtctatgaccatgaacggggctgtgattcccgtgctggctaatttcatcgtgaccggagaggagcagggcgtgccaaaggagaagctgacaggaacaattcagaacgacattcttaaggagtttatggtgagaaacacctatatattcccccccgagcccagtatgaagatcatcgctgacatcttcgagtacacagctaagcacatgcctaagtttaacagcatcagtatcagcggctaccacatgcaggaggccggcgccgacgctatcctcgagctggcttacaccctggccgatggcctcgagtactcgagaaccgggctgcaggcgggactgaccatcgatgagttcgcccccaggctcagtttcttctggggaatcggcatgaacttctatatggagatcgccaagatgagggccggaagaagactttgggcccacctcattgagaaaatgttccagcccaagaatagcaagtcactgctgctgagggcacactgccagaccagcggatggagcctgactgaacaggacccctacaacaacatcgttcggaccgcaatcgaagccatggccgcagtgttcggagggacccagtctctccataccaactccttcgacgaagccctcggtctgcctacagttaaaagcgccagaatcgctcggaacacccagatcatcatccaggaggaaagcgggatacccaaggtggctgacccctgggggggttcctacatgatggagtgcctgaccaatgacgtgtacgatgccgcactcaagctgattaatgagatcgaagaaatgggaggaatggctaaggctgtggccgaaggaatcccaaagttgagaatcgaggagtgcgctgccaggaggcaggcccgcatcgacagcggaagcgaagttatcgtgggcgttaataagtatcagctggagaaggaggacgccgtggaggtgctggctatcgacaacacctcagtcagaaaccgccagatcgaaaaactgaaaaaaattaagtcgagccgagatcaggcactcgccgagcgttgcctggccgccctgactgagtgcgccgcctcaggagacggcaacatcctggccctcgccgttgacgccagtagagcccgatgcactgtgggagagattactgacgccctcaagaaggtgtttggagagcacaaagccaacgataggatggtgagcggcgcttacagacaggagttcggcgaatctaaggaaatcacttctgccatcaaaagagttcataagtttatggagagagaggggagaaggccccgcctgcttgttgccaagatgggacaggacggccatgatagaggagccaaggtgatcgccaccggcttcgcagaccttggcttcgacgtcgacattggacccctgttccagaccccaagagaggtggctcaacaggccgtggacgccgatgtccacgccgtgggcgtgtctaccctggccgccggccacaagacactcgtgcccgagctgatcaaggagctgaacagcctcggacggcctgatatactggtgatgtgcggcggggtgatcccccctcaggactacgaatttcttttcgaagtcggagtgagtaacgtgttcggccccggaacgcgcatacctaaggctgctgtgcaggtgctggatgatattgagaaatgtcttgagaagaagcagcagagcgtg

SEQ ID NO: 168 - DNA, 2250 bp, Artificial Sequence
  Codon optimized sequence that encodes an MCM polypeptide with the I671V mutation
atgctgagggccaaaaatcagcttttcctgctcagtccacactatttgagacaggtaaaggaatcttccggctccagactgatccagcagagactgctgcaccagcagcagcctctgcaccccgagtgggccgctctggcaaaaaaacagctgaagggcaagaaccctgaggacctcatatggcacacccccgaggggatctcaatcaagccactgtacagcaagagagacaccatggacctgccagaagaactgcccggcgtgaaacccttcaccagggggccctatcctacaatgtacactttcaggccttggaccataaggcagtatgccggattctccaccgtggaggagagcaataagttctacaaggataacatcaaagccgggcagcagggcctgtccgttgcgttcgacctggccacccatagagggtacgatagtgacaaccccagggtcagaggcgacgtgggcatggccggggtcgcgatagacaccgtggaggacaccaagatcctgtttgacggcatccccctggagaagatgagcgtgtcaatgaccatgaacggcgccgtgatccccgtcctggccaatttcatcgtgaccggggaagagcagggagtgcccaaggaaaagttgacagggaccattcagaacgatatcctgaaggagttcatggtccggaatacctacatcttcccccccgagcctagcatgaagatcatcgccgacatcttcgagtacaccgccaagcatatgcctaagttcaattctatcagcatttccggctaccatatgcaagaagctggagcagacgccatactggagttggcctacaccctggccgatggcctggagtacagccggacgggcttacaggccggactgaccatcgacgagtttgcacccagactgtccttcttctggggcataggcatgaacttctacatggagattgccaagatgcgggccggcagacgtctctgggctcatctcatcgagaaaatgttccagcccaagaacagcaagtccctcctgctgagggcccactgccagaccagcggatggagcctgactgaacaggacccctacaacaacatagtgagaaccgccatcgaggccatggccgcagtgtttggagggacccagagcctgcatactaactccttcgacgaggccctgggcctgcccaccgtgaagtccgctagaatcgccagaaatacacagatcataatccaggaggagtccggcatccctaaggtggccgacccatggggcggctcttacatgatggagtgcctgaccaacgatgtgtacgacgctgctctcaagctcatcaacgaaattgaggaaatggggggaatggctaaggccgtcgccgaagggattcccaagttacgcatcgaggagtgtgccgccagacggcaggccagaatcgacagcggcagcgaggtcatcgtaggtgtgaataagtatcagctggaaaaagaggacgccgtggaggtcttggccatcgataacacaagcgtgcggaaccgccaaatcgagaaacttaaaaagattaagagcagccgggaccaggccctggccgagaggtgcctggcagccctcacagaatgtgctgctagcggtgatggcaatatactggccctggctgtcgacgccagtagggcaaggtgtaccgttggggagatcaccgacgctctgaagaaggttttcggcgagcataaggccaacgataggatggtcagcggagcttatcggcaagagttcggagagagtaaggagatcacgtccgccattaaaagagttcataagttcatggagcgggagggcagacggcctagactgctggtggctaagatgggtcaggatggccacgacaggggagcaaaggtgatcgccacaggattcgccgatctggggtttgacgtggacattggccctctctttcagacgccgagggaggtggcccagcaggcagtagacgccgacgtgcacgccgtgggcgtgtctacactggccgccggtcataagaccctggtgcccgagcttatcaaggagctgaactcactcggcagacctgacattctggtaatgtgtggcggagtgatcccaccccaggactacgagttcctgtttgaggtgggcgtgagcaacgtcttcggccccggaactagaatccccaaggccgcagtccaggtgctggacgacattgagaaatgcctggagaagaagcagcaatccgtg

SEQ ID NO: 169 - DNA, 2250 bp, Artificial Sequence
  Codon optimized sequence that encodes an MCM polypeptide with the I671V mutation
atgctgcgggccaaaaaccagctgttcttgctgtctccccactaccttcgacaggtcaaggaaagctctggcagccgtctcatccagcagagactgctgcaccagcaacagccactccaccccgagtgggccgccctggccaagaagcagctgaagggcaagaacccagaggatctgatctggcacacccccgaaggaatcagcattaaaccactctacagcaagagagacaccatggatcttcccgaggaactccccggcgtgaagcctttcacccggggaccttatcccactatgtacaccttccgaccctggaccattagacagtacgctgggttctccacagtggaggagagtaacaaattttataaggataatatcaaagccggccagcagggcctgtctgtagccttcgatctggctacccatagaggatatgatagtgacaaccccagggtcagaggcgacgtgggcatggccggcgtggccattgacaccgtggaggatactaagattctgttcgacggcattccccttgaaaagatgagcgtgagcatgacgatgaacggggccgtgatccctgtgctggctaacttcattgtgaccggagaggagcagggcgtccctaaagagaaactaacaggaactattcagaacgacatcctgaaagagtttatggtgcggaatacctacattttcccccctgagccttctatgaaaatcattgccgacatattcgagtacaccgccaagcatatgcccaagttcaactctatcagcatttctggctatcacatgcaggaggccggtgccgacgccatcctggagctggcatacaccctggcagatggcctcgagtatagccggaccggcctccaggccggcttgaccatcgacgagtttgccccacggctgtccttcttctggggcatcggaatgaatttctatatggagatcgccaaaatgcgggccggaagaagactgtgggcccacctgatcgagaagatgttccagcccaagaacagcaagagcctcctgctgagagcacattgccagaccagcggatggagcctgaccgagcaggatccctacaataatatcgttaggactgccattgaggccatggctgcagtgttcggcggaacacagtccctgcataccaacagctttgacgaagcactgggcctccccacagtgaaaagcgccaggatcgccagaaacacccagatcatcatccaggaagagagcggcatccccaaagttgctgatccatggggcggctcatatatgatggaatgtctgactaacgacgtgtacgatgctgccctcaaactcatcaacgagattgaggagatggggggcatggccaaggccgttgccgagggcatccccaaacttcgaattgaggagtgcgctgccagaagacaggctagaatcgacagcggctctgaggtgatcgtcggagtcaacaagtaccagcttgagaaggaagatgccgtggaagtattggccatcgacaacacatccgtgagaaataggcagatcgagaaactgaaaaaaatcaagagctctcgcgaccaagcccttgccgagagatgtctggccgccctgaccgaatgtgcagcgagcggcgatggcaacatcctcgccctggccgtggacgcctctagggcccggtgcacagtgggcgagatcaccgacgccctcaagaaggttttcggcgaacacaaggcaaacgacaggatggttagcggggcttaccgccaggagttcggggagtctaaggagataaccagcgccatcaagcgcgtgcacaagttcatggaaagagaaggtagacggccaagactcttggtggccaaaatgggccaggacggtcacgaccggggcgctaaagtgatcgccaccggcttcgccgacctgggattcgacgtggacatcggacccctgtttcagacaccccgagaggtggcacaacaggccgtggatgccgatgttcatgccgtgggagtgagcactctcgccgccggccataagacactcgtcccggaactgattaaggagttaaatagcctgggccggcccgacatcctggtgatgtgcgggggcgtgatccccccccaggactacgagttcctatttgaggtgggagtcagcaacgtgttcggccccggtacccggatccccaaggccgcagtgcaggttctggacgacattgagaaatgcctggagaagaagcagcaaagcgtg

SEQ ID NO: 170 - DNA, 2250 bp, Artificial Sequence
  Codon optimized sequence that encodes an MCM polypeptide with the I671V mutation
atgctcagagccaagaatcagctatttcttctgagcccacattatctgagacaggtgaaggagagcagcggaagcaggttgatacagcagcggctcctgcatcagcagcagcctctgcatcccgagtgggccgcactggcaaagaagcagctgaagggcaagaaccctgaggacttgatctggcacacacccgagggcatctctatcaagcctctctatagcaagagagatacaatggatctgcccgaggagctgcctggggtgaagcctttcactcggggcccctaccccaccatgtacaccttccgcccttggaccattaggcagtacgccggcttctccacagtcgaggagagcaacaagttctataaagataacatcaaggcaggacagcaaggcctgtccgtggcctttgaccttgccacacacaggggctatgacagcgataatcctagagtgcgcggcgacgtaggcatggcaggcgtggcaatagataccgtggaggacacaaagatcctgtttgacggcatccccctggaaaagatgtccgtgagcatgaccatgaacggggcggtgatcccagtgctggccaactttatagtaaccggcgaagagcagggcgtgcccaaggagaagctgactggcacaatccagaatgacatcctgaaggagttcatggtgaggaacacatacatctttccccctgagcccagcatgaagatcatcgcagatattttcgaatacacagcaaagcacatgcccaaattcaacagcatctccatctccggctaccatatgcaggaggccggcgccgacgccattctggagctggcctacaccctcgccgacggtctcgagtactcacgcacaggccttcaggccggcttgacaatcgatgaattcgcccccagattgagctttttctggggcattggcatgaatttttatatggagatagcgaaaatgcgggctggcagaagactatgggcccatctgatcgaaaaaatgttccagcccaagaacagcaagtcccttctgctgagagcacattgccagacctctggatggagcctcaccgagcaggacccttataacaatattgttagaaccgcaattgaagctatggcagctgtgttcggaggcacccagagcctgcacacaaactcttttgatgaggcacttggactgcccactgtgaagagtgccagaatcgctagaaacacacagataatcatccaagaggagagtggcatccctaaggttgcggacccttggggcggcagctacatgatggagtgccttactaacgatgtgtacgatgcagccctgaagctcattaatgagatcgaagagatgggcggcatggcaaaggcagtggcagagggcatccctaaattgagaatcgaagagtgcgccgccagaagacaggcccggatcgactcaggcagtgaagtcatcgtgggggtgaacaagtaccaactcgagaaagaagatgccgtggaagtgctggccatcgataacacctccgttagaaaccgacagatcgaaaagctgaaaaagatcaaaagcagcagagatcaggccttagccgagagatgtttggccgccctcacggagtgtgccgccagcggcgacggcaacatcctggcccttgccgtggacgctagtagggctaggtgcactgtgggcgagattacagatgctctgaaaaaagttttcggagagcacaaggccaacgatcgtatggtgagcggagcgtatcggcaggagtttggcgagtctaaagagatcacctcagctatcaaacgcgtccataagttcatggagcgggaaggcaggaggcctcggctgctggtggcaaagatggggcaagatgggcacgatagaggtgccaaggtgatcgccaccggattcgctgaccttgggttcgacgtagacattgggccactgttccagacacccagagaggtcgcccaacaggctgtggatgccgacgtgcacgcggtgggcgtgagtactctggccgcgggccataagaccctggtgcccgaactgatcaaggaactgaatagcctgggcaggcccgatattctggtgatgtgcggcggggtgatcccccctcaggactatgagttcctttttgaggtgggcgtgtctaacgtgttcggccccggcacccggatccctaaggctgccgtgcaagtgctcgacgacatcgagaaatgcctggaaaagaagcagcagagcgtg

SEQ ID NO: 171 - DNA, 2250 bp, Artificial Sequence
  Codon optimized sequence that encodes an MCM polypeptide with the I671V mutation
atgctgagagcaaagaaccagctgttcttactgagcccccactacctgaggcaggtgaaagagagttcagggtcacgtctgatccagcagagactgctccaccagcagcagcccctgcatcccgagtgggccgccctagctaagaagcagctgaagggcaagaaccccgaggacctgatctggcacactcccgaagggattagcatcaagcccctctacagcaagagagacaccatggacctgcccgaggagctccccggagtgaagccattcacaaggggcccctacccaaccatgtataccttcagaccctggacaatcagacagtacgcgggcttttccactgtggaagaatctaacaagttctacaaagacaatataaaggctggccagcagggactgagcgtggcattcgatcttgccacacaccgcggctacgattctgacaaccccagggttaggggagacgtgggaatggccggcgtggccatcgacaccgtggaggacacaaagatcctgttcgacggaatcccacttgagaagatgtcggtgtccatgaccatgaacggggccgtcatccctgtactggctaacttcatcgtgaccggggaggagcagggcgtgcccaaggagaagctgacaggcaccatacagaacgacatcctgaaggagtttatggtgagaaacacctatatcttccccccagaaccctcaatgaagatcatcgctgacatctttgagtataccgctaagcacatgcctaagttcaatagcatctccatcagcgggtaccacatgcaggaagccggcgccgatgctatcctggaattagcttacaccctggccgacggactcgagtacagcagaaccggactgcaagccggcctgaccatcgacgagttcgctcctaggctgtcctttttctggggcattggcatgaacttctacatggaaattgccaagatgagggccggccgccgcctgtgggcccacctcattgagaaaatgtttcagcccaagaactccaagtccttgttgctgagagcccattgccagacctccgggtggagcctcacagaacaggacccctacaataacattgtgagaaccgccatcgaggccatggccgcagtcttcggcggcacacagtccctgcacactaactcctttgatgaagccctgggcctgcccactgttaagtctgccagaatcgcccgcaacacacaaatcattatccaggaggaatccggcatccccaaggtggccgacccttggggcgggagctatatgatggagtgcctcaccaacgatgtgtatgatgccgcccttaaactgatcaacgaaatagaggagatgggcggcatggccaaagccgtcgccgagggcattcctaagttgagaatcgaggagtgcgccgccaggagacaggctaggatcgacagcggcagcgaggtcatcgtgggtgtgaacaagtaccagctggaaaaggaggacgccgtggaggtgctggccatcgacaacacctctgttaggaacaggcaaattgagaagctgaagaagatcaagtccagcagagaccaggctctggccgagagatgtctggccgcacttaccgaatgtgctgccagcggggacggcaacatactggcgctcgccgtggacgccagccgagctagatgcaccgtgggcgaaattacagacgctttgaaaaaggtgttcggcgagcacaaggccaacgataggatggtcagcggagcctaccgccaggagttcggcgagtctaaggagatcacctcagcgattaagagggtgcacaaatttatggagagagagggacggagacccaggctgctggtggccaagatgggacaggacggccacgatagaggagctaaagtcatcgccacaggattcgccgacctaggcttcgatgtcgacatcggacccctgttccaaaccccccgggaagtggcccagcaggctgtggacgccgatgtgcacgccgtgggagtgtctacactggccgccgggcacaagaccctggtccctgaacttatcaaagagctcaacagcctcggcagacccgatatcctggtcatgtgtggcggcgtcataccaccccaggactatgagttcctgtttgaagtgggcgtgagcaacgtctttggccctggaaccaggatcccaaaggctgcagtgcaggtgcttgacgacatcgagaagtgcctggagaagaagcagcagagcgtg

SEQ ID NO: 172 - DNA, 2250 bp, Artificial Sequence
  Codon optimized sequence that encodes an MCM polypeptide with the I671V mutation
atgctgcgagccaagaaccagttgttcctactgagcccccattaccttcggcaagtcaaggagagcagcggcagcagactgatccagcagagactcctccaccagcagcagcccctgcaccccgagtgggctgccctggccaaaaaacagttaaaaggaaaaaaccctgaggacttgatctggcacacccccgaaggcattagcatcaaacccctgtatagcaagagagacacaatggacctgcccgaggagctccccggcgtgaagccctttaccagaggcccctaccccaccatgtatacgttccggccatggaccatcagacagtacgccggtttttctacagtggaagagagcaacaagttctacaaagacaatattaaagccggccagcagggcctgtcagtcgccttcgatctggccacccaccgtggctacgatagcgacaatcctcgagtgagaggagatgtgggaatggctggagtggctattgacaccgtcgaggacaccaaaattctgttcgacggcatcccactggagaagatgtccgtgtccatgaccatgaacggcgccgttattcccgtactggctaacttcatcgtgacgggcgaggagcaaggggtgcccaaggagaagcttacaggcaccatccagaatgatatcctgaaggagttcatggtgagaaatacatacatcttcccccctgagcccagcatgaagatcattgccgatatcttcgagtacaccgcaaagcacatgcccaaatttaacagcatctccatcagcggataccacatgcaggaggccggcgccgatgctatcctcgagttggcttacacactcgccgacggtttggagtacagtcgcaccgggctgcaggctggtcttaccattgacgagtttgcccctcggctcagcttcttctggggcatcggcatgaatttctacatggagattgccaagatgagagcaggacgaagactttgggcgcacctcatcgaaaagatgttccaacccaagaatagcaaatctctcctgctgagggcccattgtcagacctccggctggtctcttaccgagcaggatccttacaataacattgtcagaacagcaattgaagcaatggccgctgtgttcggcggcactcagagcttgcatactaactctttcgacgaggctctgggcctgcctaccgtgaaaagcgccagaattgctcgaaatacacagatcatcatccaggaggaatccggcattcccaaggtggccgacccctggggaggcagttatatgatggagtgcctgaccaatgacgtgtacgacgccgcactgaaactgattaacgagatagaagaaatggggggcatggccaaagccgtggccgagggcatcccaaagctgagaatcgaggaatgcgccgccaggcggcaggccagaatcgacagcggctccgaagtgattgtgggcgtcaacaagtaccagctggagaaggaggacgccgtggaggttctggccatcgacaacaccagcgtgaggaacaggcagatcgagaagctgaaaaagatcaaaagctcacgcgatcaggccctggccgagaggtgtctggccgccctgacagagtgtgctgcaagcggcgatgggaatatcctggcactggctgtcgacgcttcccgcgcaagatgtaccgtgggcgagatcaccgatgccctgaaaaaggtgttcggcgagcacaaggccaacgaccggatggtgagcggcgcctacagacaggagtttggcgagtccaaggagattacaagcgctattaaaagggtccacaagtttatggagcgagagggaagaaggccaagactgctggtcgctaaaatgggtcaggacggtcacgataggggggccaaggttatcgccaccggcttcgccgatctgggcttcgacgtggacattggccccctgtttcagacccccagagaggtagcccagcaggccgtggatgccgacgtgcatgcagtgggcgttagcaccctggccgcgggccataaaaccctggtccccgagttaattaaagagctgaactctctgggacggcctgacatcctggtgatgtgcggcggcgtgatcccgccccaagactacgagtttctgttcgaggtgggcgtgtctaatgtgtttgggcctggcaccagaatccctaaggcagctgtgcaggtgctggacgacatcgagaagtgcctggagaaaaagcagcagtcagtc

SEQ ID NO: 173 - DNA, 2250 bp, Artificial Sequence
  Codon optimized sequence that encodes an MCM polypeptide with the I671V mutation
atgcttcgagccaagaaccagctgtttcttctgagcccccattatctgagacaggtcaaggagagctcaggcagcagactcatccagcagagactgctacaccaacagcagccgctccaccccgagtgggccgccctggccaaaaagcagctcaagggcaagaatcccgaggatctcatttggcacactcctgagggtatcagcatcaagccgctctacagcaagagagacacgatggatctgccggaggagctgcccggcgtgaagccctttacgaggggcccgtaccccaccatgtacacattcagaccctggaccatcaggcagtacgccggcttctccaccgtcgaggagagtaataaattctacaaagataatatcaaggccggccagcaaggcctcagcgtcgccttcgacctggcaacccatcgcggttacgattcagataatccacgtgtgagaggagacgtaggcatggcaggcgtggccatcgacaccgtggaggacaccaagatcctgttcgacggcattcccctggagaagatgagcgtcagcatgacaatgaatggcgctgtaattcccgtgctcgctaatttcatcgtgacaggcgaggagcagggagtgcccaaagaaaagctgactggcactatccagaacgacatcctgaaagaattcatggtgcgtaacacatacatcttccctcccgaacccagcatgaagatcattgcagacattttcgaatacaccgccaaacatatgcccaagttcaacagcatatctattagcggctaccatatgcaggaagccggggcagatgccatcctggaactggcatacacactggccgacgggctcgagtactccagaaccgggctgcaggccggactaaccatcgatgagtttgctcccagactgagctttttctggggcatcggcatgaacttttacatggagattgccaagatgagggctgggagaagattgtgggcccaccttatcgagaagatgtttcagcccaagaacagcaagtccctgctcctcagagctcattgtcagacgagcggatggtccctcaccgagcaggacccctacaacaacatcgtgaggaccgctattgaggctatggctgccgttttcgggggcacccagtcactgcacacaaactccttcgatgaggccctgggcctgcccaccgtgaagtctgcccggatcgctaggaacactcagattattatccaggaggagagcggaattcccaaggtcgccgacccttggggcggctcttacatgatggaatgtctgaccaatgacgtgtatgacgccgccctgaagctaatcaacgagatcgaagaaatgggcggtatggccaaggccgtggccgagggtatccctaagctgcggatcgaagagtgcgctgctaggagacaggccagaatagacagtgggagcgaggtcatcgtgggcgtgaataagtatcaactcgagaaggaggacgccgtggaagtgctcgccattgacaatacctccgtgagaaaccggcagatcgaaaaactaaagaagatcaagagcagtagggaccaggctctggcagagaggtgcctggccgcgctgaccgagtgcgccgcaagcggcgacgggaacatcctcgcactggccgtggacgccagcagagctcggtgtacagtgggagagatcaccgacgcccttaaaaaggtgtttggcgagcataaggcgaacgatcgcatggttagcggagcttacagacaggagtttggtgagagcaaggagatcacgagtgctatcaagagggtgcacaaattcatggagcgcgagggcaggcgccctagactcctcgtcgccaagatgggtcaggacggtcacgacaggggcgcaaaggtgatcgccaccggctttgccgacctaggcttcgacgtggacattggccccctcttccagacgcccagagaagtggcccagcaagctgtggacgccgatgtgcacgcggtgggagtgagcacactcgccgccggccacaagaccctggtgcccgagctgattaaggagctcaactcactggggagacccgacatcctggtcatgtgcggtggagtgatccccccccaagactatgagtttctcttcgaggtaggcgtgagtaacgtgttcgggcccggcaccagaatccctaaggcggccgtccaggtgctggacgatatcgagaaatgtctggagaagaagcagcagagcgtt

SEQ ID NO: 174 - DNA, 2250 bp, Artificial Sequence
  Codon optimized sequence that encodes an MCM polypeptide with the I671V mutation
atgttaagagccaaaaaccagctgttccttctgagcccccattatctgcggcaggtgaaggaatccagcggctccagactcatccaacagaggctcctacaccagcagcagcccctgcacccggagtgggcagctctggcaaagaagcagctcaagggcaagaaccccgaagatctgatctggcacacccccgaaggaatcagcatcaagcctctctatagcaagagagataccatggatctgcccgaggagctgcccggagtgaagccttttactcggggaccttaccccactatgtacactttccgcccctggaccatcagacagtacgcgggcttctcgaccgtggaagagagtaataagttctataaagacaacatcaaagccggccagcagggtctcagcgtggcgttcgatctggctacacacagagggtacgatagcgacaacccaagggtgaggggggacgtgggcatggcgggggtggccatcgataccgtggaagacaccaagatcctgttcgacggtatccccctagagaaaatgtcagtcagcatgacgatgaacggcgcagtaatccccgtgctcgcaaatttcattgtgaccggcgaggagcagggggtgcctaaggagaagctgaccggcaccatacagaacgatattctgaaggagttcatggtaaggaatacatacatcttccctcctgagcccagcatgaagatcatcgccgacatcttcgagtacactgcgaagcacatgcccaaatttaattccatatccatctcgggctaccacatgcaggaagccggcgccgatgcaatactggaactggcttacaccctggccgacgggctggagtacagcaggaccggcctccaggcgggcctgaccattgacgaatttgcccccagactcagcttcttctggggaatcgggatgaatttttacatggagatcgccaaaatgagagcaggcaggagactgtgggctcacttgatcgagaaaatgtttcagcccaagaacagcaaaagccttctgctcagagcccactgccagactagcggctggtctctgaccgagcaggacccctataacaacatcgtgagaaccgccatcgaggccatggccgccgtgttcggcggaacacagtctctgcataccaactccttcgacgaggcgctgggactgccaacggtcaagagcgcccgcattgcaaggaacacccagataatcatccaggaagagtctggaattcctaaggtggcggacccctggggaggctcttacatgatggaatgcctgacaaatgatgtctatgacgctgcactgaaactgatcaacgagattgaggagatgggtggcatggccaaggccgtggccgagggcatcccaaaactgagaatcgaagagtgtgccgcccggagacaagccaggatcgactccggaagcgaagtgattgtgggagtcaataagtaccaattggaaaaggaggacgccgtggaggtgctagctatcgacaatacctccgtgcgcaacaggcaaatagagaagctgaaaaagatcaagtcatcccgggatcaagccctggctgagaggtgtttggccgccctcacggaatgcgctgccagcggcgacggaaacatcctggccctggccgtcgacgccagcagagccaggtgcaccgtgggtgaaattaccgacgctctgaagaaggtgttcggtgaacacaaagccaacgacagaatggtgagcggtgcctacagacaggagttcggcgagtccaaggagatcacttcggccatcaagagggtgcacaagtttatggagcgggagggcaggaggcccagactcctagtggcaaaaatggggcaggacggccatgataggggggccaaagtgatcgccaccggattcgcagacttgggcttcgacgtggatatcggacccttgtttcagaccccccgcgaagtcgcacagcaggcggtggacgcggatgtgcacgctgttggcgttagcacactggctgccggccataaaaccctggtgcctgagctgattaaggaactgaacagtctcggacggcccgatatccttgtgatgtgcggaggcgttatccctccccaggactacgagttcttgttcgaggtgggcgtgagcaatgtctttggtccaggaactaggattcccaaggctgccgtgcaggtgctggacgacatcgaaaagtgccttgagaagaagcagcagtctgtg

SEQ ID NO: 175 - DNA, 2250 bp, Artificial Sequence
  Codon optimized sequence that encodes an MCM polypeptide with the I671V mutation
atgctgagggctaaaaaccaactgttcctgctgagcccccactacctgcgccaggtgaaagagtctagcggtagcaggctcatccagcagaggctgctgcatcagcagcagcccctccaccccgagtgggctgccctcgccaagaaacagttaaaggggaagaatcccgaggacctgatttggcacaccccggagggcatcagtattaagcctctgtacagcaagagagacaccatggacctgcccgaggaactccctggggtgaagcccttcaccaggggaccctatccgaccatgtacacattcaggccttggaccatcagacagtatgcaggcttcagcaccgtggaagagagcaacaagttctacaaggataatatcaaggccggacagcagggactgagtgtggccttcgatcttgccacccacagaggctatgactctgacaatcccagagttcgtggggacgttgggatggccggagtggccattgatacagtggaggacaccaagatcctgtttgacgggatcccgctggagaaaatgagcgtgtccatgactatgaacggggcagtgatcccagtgctggctaacttcatagtgactggagaggagcagggcgtgccgaaggagaagctcacaggcaccatccagaatgacatcctgaaagaattcatggtgcgtaatacttacatattccccccagagcccagcatgaaaatcatcgcggacatttttgagtacaccgccaagcacatgcccaaatttaactcaattagcattagtggctatcatatgcaggaggccggtgccgacgcaatcctggaactggcttacaccctggctgacggccttgagtatagccggacaggcctgcaggcaggcctgactatcgatgaatttgccccacgcctgtctttcttttggggcatcggcatgaacttttacatggagattgctaagatgcgcgctggcagaagactctgggcccacctgattgagaagatgttccagcccaagaactcaaagtccctgctgctgagggcccactgtcagacttctggatggagcctgaccgagcaggatccctataacaacatcgtgcgtaccgccattgaagccatggctgctgtattcggcggtacccagagcctgcataccaacagcttcgatgaggccctgggcttgcccaccgtgaagtctgcacgtatcgcccggaacacccagatcatcatccaggaggaatccggcatccccaaggtggccgacccctggggaggcagctacatgatggaatgcctcaccaacgacgtgtacgacgccgctctcaagttaatcaatgagatcgaggagatgggcggcatggccaaagctgtggcagagggaatcccaaagctgaggatcgaggagtgcgccgctagaaggcaggcccgcatcgatagcggctcagaggtgatcgtgggcgtgaataagtatcagctggagaaagaagacgccgtggaagtgctggcgatcgacaatacctccgtgcgaaacagacagatcgagaagctgaagaagatcaagtcgagccgcgaccaggccctggccgagagatgtctggcagccctgaccgagtgcgcagccagcggcgacggcaatatcctggccctggccgtggacgcctcccgcgcgaggtgcacggtgggcgagattacggacgctttgaaaaaggtgttcggcgagcacaaggccaatgacaggatggtgtccggggcctatcgacaagaattcggggagagcaaagaaatcacctccgccattaagagagtccacaagttcatggagagagagggccggagacccagacttctggtcgccaagatgggccaagacggccatgataggggcgcaaaggtgatcgccaccggatttgccgacctgggcttcgacgtggatatcggacctcttttccagactcccagagaggtggcccagcaggccgtagacgccgacgtgcatgctgtaggtgtgagcacgctggccgccggccataagaccctggtccccgaactaatcaaggagctgaactccctcggcagacccgacatcctggtgatgtgtggcggcgtgatccccccacaggactatgagttcctgtttgaggtaggcgtgagcaacgttttcggcccaggaaccaggatccctaaggctgccgtgcaggtgctggatgacatcgaaaagtgcctggagaagaagcagcaatcagtt

SEQ ID NO: 176 - DNA, 2250 bp, Artificial Sequence
  Codon optimized sequence that encodes an MCM polypeptide with the I671V mutation
atgcttagagccaagaatcagctcttcctgctgagcccccattatcttagacaggtgaaggagagttcgggctctcggctgatccagcagagactgctgcaccagcagcagccattgcaccccgagtgggccgcgctggcgaagaaacagctgaagggcaagaaccccgaggatctgatctggcacacaccagaaggcatcagcatcaagcccttgtatagcaagcgggacacaatggatctccccgaggagctgcccggcgtaaagcccttcactcgaggcccctaccctacgatgtacaccttcagaccatggactattcggcagtacgctggattctccaccgtggaggaatctaataaattctataaggataatatcaaggccggccagcagggcctgagtgtcgcgttcgacctggccacccataggggatacgactcagacaaccccagggttcggggcgacgtgggcatggccggcgtcgccatcgacaccgtagaggacacaaaaatcctgttcgacggcattcccctggagaaaatgagtgtgagcatgactatgaacggcgcagtgattcccgtgctggccaatttcatagtgacaggggaggaacagggggtccccaaagagaaactcaccggcaccattcaaaacgacattctgaaggaattcatggtgcggaacacatacattttcccccccgaaccaagcatgaagatcattgctgatatcttcgagtacacagcgaagcacatgccaaagttcaactctatttctatctccgggtatcacatgcaggaggcaggagccgatgccatcctggagctggcttacaccctggcagacggcctcgagtactcgcgaaccggactgcaggccggcctcaccatcgatgagtttgcaccccggctcagcttcttctggggcatcggtatgaacttttatatggagatcgctaagatgcgcgcaggtcgtagactttgggcccacctcatcgaaaaaatgtttcaacccaagaattccaaatccttgctgcttagagcccattgccagacatccggctggagtctgaccgagcaggacccctacaacaacattgtgagaacagcgatcgaggcaatggccgccgtgttcggcggaacccagagcctccataccaactcctttgacgaggccctcggactgccaaccgtcaagagcgccaggatcgccagaaacacccagatcatcatccaggaggagagcggcattccaaaagtggccgatccttggggcggctcctacatgatggagtgcctcactaatgatgtgtacgacgccgccctgaagctgattaacgagattgaggagatgggcggaatggctaaggccgtggctgaagggatccccaaattgagaattgaggaatgcgccgctagaaggcaggctcgcatagactcaggctccgaggtcatcgtgggcgtcaataaatatcagctggagaaggaggacgctgtagaggtgctggcaattgataacacctctgtgcggaacagacaaattgaaaaattaaagaaaattaagagcagcagagaccaagccctggccgagcgctgcctggccgccctgaccgagtgcgccgccagtggcgacggaaacattctagcactggctgtggacgcctcgcgtgcgagatgcaccgtgggcgagataacagacgccctgaagaaggtgttcggcgagcacaaggccaacgataggatggtgtctggagcctatagacaggagtttggcgaaagcaaagagatcacaagcgctattaagagagtgcacaagtttatggagagagaaggccgcagacccagactcctggtcgccaagatgggacaggacggtcacgaccggggtgccaaagtaatcgctaccggctttgccgacctgggcttcgacgtcgatattggccctttattccagaccccgcgggaggtagctcagcaagccgtcgacgctgatgtgcacgccgtgggagtgtctaccctggccgccggacacaagacgctggtgcccgagctgatcaaggaactgaatagcctgggcagaccggacatcctggttatgtgcggaggggtgattcccccacaggattacgaattcctcttcgaggtgggggtgtcaaatgtgttcgggcccggaactagaatccccaaggccgccgtgcaggtgctcgacgacatcgaaaagtgtttggagaagaagcagcagagcgtc

SEQ ID NO: 177 - DNA, 2250 bp, Artificial Sequence
  Codon optimized sequence that encodes an MCM polypeptide with the I671V mutation
atgctgagagccaaaaaccaactcttcctgctgagcccacactacctgcgccaggtcaaggagtcaagcggcagcagactgatccagcagagactgctccaccagcagcagcccctgcatcctgagtgggccgctctggccaaaaaacagctgaagggcaagaaccccgaggacctgatctggcacacccccgagggcatcagcatcaaacccctgtattcaaagcgggacacaatggacctccctgaggagctgcctggcgtcaagccattcacgaggggcccataccccaccatgtacacgttcaggccctggaccatccggcagtatgccggattcagtaccgtcgaggagtctaacaagttttacaaggacaacatcaaggcaggacagcagggcctgtctgttgcatttgacctcgccacacaccgaggctacgacagcgataaccccagagtcaggggcgatgtgggcatggccggcgtggccatagacacagtggaggataccaagatcctgttcgatgggatcccactggagaagatgtccgtgagcatgacaatgaatggcgccgtcatccccgtgctggctaatttcattgttaccggagaagagcagggagtgccaaaggagaaactgaccggcaccatccagaatgatatccttaaggaattcatggttaggaacacatacattttcccacccgagccatctatgaagattattgccgacatcttcgaatataccgccaagcacatgccgaaattcaactctatctcaatcagcgggtaccatatgcaagaggccggagccgatgctatcctggaactcgcttacaccctggccgacggcctggagtacagcagaactggcctgcaagctggactgactatcgatgagttcgcgccgcggctgagcttcttctggggcatcggcatgaacttttatatggagattgccaaaatgcgcgccggcaggagactctgggcccacctgatcgagaaaatgttccagcccaaaaacagcaaaagcctgcttctgcgtgcccattgccaaaccagcggctggtctctgactgaacaggacccttacaacaatatcgtgaggaccgccattgaggccatggccgccgtgtttggtggcactcagagcctgcacaccaattctttcgatgaagccctgggcctgcccacagtgaaatccgccagaatcgccagaaacacacagatcatcatccaggaggagagcggcatccccaaagttgctgacccctggggcggctcctacatgatggagtgcctcaccaacgacgtgtacgacgcagctttgaaacttatcaacgagattgaggagatgggaggaatggcgaaggccgtggccgagggtattcccaagctgaggattgaagaatgcgcagccagaagacaggcacggatcgattccggcagtgaagtgattgttggagtgaacaagtaccagctggagaaagaggacgccgtggaagtcctggccatcgataatacaagcgtgagaaacagacagattgaaaagctgaagaagatcaagtctagccgcgatcaggctctggccgagagatgcctggccgccctcaccgaatgcgcagccagcggcgatgggaacatcctcgcactggctgtcgacgcttccagagctagatgcaccgtgggtgagatcacggacgctctgaagaaggtgttcggcgagcacaaggccaacgacaggatggtgagcggtgcataccgtcaggaatttggtgagtccaaggaaattacctccgcaatcaagagagtgcacaaattcatggaaagggaaggtcgaagacctagactgctggtcgccaagatggggcaggacggccatgataggggcgccaaggtcatagctaccgggtttgcggacctgggcttcgacgtggacatcggccctctcttccagaccccccgggaagtggcccagcaagccgtggacgctgacgtgcacgctgtcggagtgtccaccctggctgcaggacacaagaccctggtgcccgagctcattaaagagctgaactctctgggccgccccgacattctcgtgatgtgcggcggcgtgatcccccctcaggattacgagttcttgtttgaagtgggcgtgagcaacgtgttcggccctggcaccagaattcctaaagccgcagtccaggtgctcgatgacatcgagaaatgcctggagaaaaaacagcagagcgtc

SEQ ID NO: 178 - DNA, 2250 bp, Artificial Sequence
  Codon optimized sequence that encodes an MCM polypeptide with the I671V mutation
atgctaagggcgaagaaccagttgttcctcctcagcccacattatctgaggcaggtgaaggagagcagtggatcaaggctgattcagcagaggctgctgcaccagcagcagcccctgcacccagagtgggccgccctggctaagaagcagctgaaaggcaagaaccccgaggatttgatttggcacaccccagagggaatctctatcaagcctctgtacagcaaacgcgacacaatggacctgccagaggagctgccaggcgtgaagcctttcacacgggggccttaccctaccatgtacacattcagaccctggaccatcagacagtacgccggcttctccaccgttgaggagtccaataagttctacaaggacaacattaaagccggacagcagggcctcagcgtggcctttgacctcgccacccacaggggctacgacagcgataacccccgtgtgagaggggacgtgggaatggccggggttgctatcgatactgtggaggacactaagatcctctttgatggcattcccctggaaaagatgagcgtctctatgaccatgaacggggccgtgatccccgtgctggccaactttatcgtgactggcgaggagcagggggtgccaaaagagaagctgacaggaaccattcagaacgacatcctgaaggagtttatggtcaggaacacctacattttcccccctgagccaagcatgaagatcatcgccgatattttcgagtataccgcgaagcacatgcctaaattcaactctatcagcatcagcggctaccacatgcaggaggccggcgcggatgccattctggagctggcctacacactggccgacggcctcgaatacagccggactggcctgcaggctggcttgacaatcgacgagttcgctccaagactgagcttcttctggggcatcgggatgaacttctatatggagatcgctaagatgagagccggaagaagactgtgggctcacctgatagagaagatgtttcagcctaagaattctaagagtctgctgctgagggcgcactgccagactagcggctggtccctgaccgagcaggatccatataacaacatcgtgagaacagctattgaagccatggccgccgtgtttggcggaacacagagcctccacaccaactcttttgacgaggctctgggattgcccaccgtgaagagcgccagaatcgccagaaatacccagatcatcattcaggaggagtcaggcatccccaaggtggctgacccctggggcgggtcttacatgatggagtgtctgaccaacgacgtatacgacgccgccctcaagcttattaatgaaattgaggagatgggtggcatggccaaagctgtggcagagggcatccccaaactgcggatcgaggagtgcgccgccagacggcaagcaaggattgacagcggctctgaagtgatcgtcggcgtcaataagtatcagctggagaaggaggacgccgtggaggtactggccatagacaacacctctgtgcggaaccgccagatcgagaagcttaagaagatcaagagcagtagagatcaggcactggctgaaaggtgcctcgctgctctgactgaatgtgctgcctctggcgatggcaacatcctggcccttgccgtggacgcttcacgggccaggtgcacagtgggagagattaccgacgccctgaagaaagtgttcggtgagcacaaggccaacgaccgtatggtgagcggcgcttaccggcaggagttcggcgaatccaaggagatcaccagtgccatcaagagagtccacaagtttatggaaagagagggccgcaggcctcggctcctggtggctaagatggggcaggatggacacgacaggggcgccaaggtgatcgctactggcttcgccgaccttggctttgacgtggatatcggccccctgttccagacccccagggaggtggcccagcaagcggtggacgcggacgtgcacgctgtgggcgtgagcacactggccgccggccacaagactctggtgcccgagctgatcaaagagcttaactcactcggccgcccagacattctggtaatgtgcggcggagtcatcccaccccaagactatgaattcctgttcgaagtgggagtgagcaatgtgttcggccctggcaccagaatccccaaagctgccgtgcaggtcttggatgacatcgagaaatgcctggagaagaagcagcaaagtgtc

SEQ ID NO: 179 - DNA, 2250 bp, Artificial Sequence
  Codon optimized sequence that encodes an MCM polypeptide with the I671V mutation
atgctgagggccaaaaaccagctgttcctgctcagccctcattacctaagacaggtcaaggagagctccggcagcagactgatccagcagcgattactgcaccagcagcagccgctgcaccccgagtgggccgccctcgccaaaaagcagctgaagggcaagaacccagaggacctcatttggcatacccccgagggcataagcattaagcccctctattctaagagggataccatggacctgcccgaagagctgcccggcgtcaaaccctttaccagggggccttacccgactatgtacacattcagaccctggactatcagacagtacgcagggttctccacggtcgaagagagcaacaagttctacaaggacaacatcaaagccggccagcaagggctcagcgtcgcattcgacctggctacccacaggggctacgactctgacaaccctagagtgagaggggacgtggggatggctggagtcgccatcgacaccgtggaggacaccaagatcctctttgatgggatcccactggagaaaatgtccgtgagcatgaccatgaatggggccgtgatccctgtgttagccaactttatcgtgacaggagaggaacagggggtgcccaaggaaaagttgaccggcaccatccagaacgatatcctgaaagagttcatggttaggaatacctacatcttcccccccgagccctctatgaagatcatcgccgacatatttgaatataccgcgaaacacatgcccaagttcaacagcatttctatcagcggctaccacatgcaggaagccggcgctgatgccatcctggagctcgcctacacactggcggatggcctggagtacagcagaacaggcctccaggctggcctgaccatcgatgagttcgcaccccgcctttccttcttctggggaattggtatgaatttttacatggaaatcgcgaagatgcgcgccggcaggagactgtgggcacatctgatcgagaagatgtttcagcctaagaacagtaaatcgctgctgctgcgggcccattgccagacgtccgggtggtcactgaccgaacaggatccctacaacaacatcgtcagaactgccatcgaggccatggccgccgtgttcgggggaacccaatccctgcacaccaattctttcgacgaggcactgggcctgcccaccgtgaagagcgccagaattgcccggaatacccagattatcatccaggaagaatccggcatccccaaggtcgcggacccctggggcggctcttacatgatggaatgcttaaccaacgacgtatacgacgccgccctgaaacttatcaacgaaatcgaggagatgggcggaatggcaaaggctgtggccgagggaatccccaagctgagaatcgaggagtgcgccgccaggagacaggccagaatagacagcgggtcagaggtaatcgtgggggtgaacaagtatcaactggagaaggaggacgccgtggaggtgctcgctatcgacaacacatccgtgagaaacagacagatcgagaaactgaagaaaattaaaagcagcagagaccaggcactggccgaaagatgcctggcagcactgaccgagtgcgctgctagcggcgacggaaacatcctggcccttgctgtggacgcctcaagggcacgctgcactgtaggcgagatcaccgacgccctcaagaaggtgttcggggagcacaaggcgaatgacagaatggtgagcggtgcctaccgccaggagtttggagagagcaaggaaataaccagcgccattaagagagtgcacaagtttatggagagagagggcaggcggcccaggctgctggtggcaaagatgggccaggacggacacgaccggggcgctaaagttatcgcgacaggctttgctgacctgggattcgatgttgacattggccccctgttccagacaccccgggaggttgcccagcaggccgtggatgccgacgttcacgccgtgggcgtcagcacactggccgccggccataagaccctggtgcccgagctgatcaaggagctgaatagcctgggtcgacccgatatcctggtgatgtgcggcggagtgatccctccccaggattatgaattcttgtttgaggtgggagtgagcaacgtttttggccctggcacccgtatccccaaggccgccgttcaggtactggacgacatcgaaaaatgcttagagaagaagcagcagtcagtg

SEQ ID NO: 180 - DNA, 2250 bp, Artificial Sequence
  Codon optimized sequence that encodes an MCM polypeptide with the I671V mutation
atgctgcgagcgaaaaaccaactgtttctgctgtccccccattacctgcgccaggtgaaggagtccagcggaagccggctcatccaacagcggctgctgcaccagcagcagcccctgcaccccgagtgggccgcactggccaagaaacagctgaaaggcaaaaaccccgaagacctgatctggcacacgcccgaaggcatcagcatcaagcccctctactccaagcgcgataccatggatctgcccgaggagctccccggcgtgaagccctttaccaggggcccctatcccaccatgtacaccttccggccctggaccatcaggcagtacgccggattcagcacagtggaggagagcaacaaattttacaaggacaatatcaaagccgggcagcaaggcctgagcgtcgccttcgacctggcgacacacagggggtacgacagcgacaatccgcgggtcaggggcgacgtcggaatggcaggcgtggccatcgacaccgtggaggacaccaaaatcctgtttgacggcatccccctcgagaagatgagcgtgtccatgaccatgaacggcgcagtgatcccggtgctggccaacttcatcgtcaccggggaggagcagggcgtcccgaaggagaagctgaccggcaccatacaaaacgacatactgaaggaattcatggtgaggaacacgtacatctttccccccgaacccagcatgaagatcatcgcagatattttcgagtataccgccaagcacatgcccaagttcaactccatctcgatcagtgggtaccatatgcaagaagccggggccgacgccatcctggagctcgcctataccctggccgacggcctggagtatagcaggaccggcctccaggccgggctgacgatcgatgagtttgcccccaggctgagcttcttctgggggatcgggatgaatttttatatggagatcgccaagatgagggccgggcggaggctgtgggcccacctgatcgaaaagatgttccagcccaagaactcaaagagcctgctcctgcgggcccattgccagaccagcggctggtccctgaccgagcaggacccctacaacaacatcgtgaggacagccatcgaggcaatggccgccgtgttcgggggcacccagagcctgcataccaactccttcgacgaggcgctggggctcccgaccgtgaaaagcgcccggatcgcacggaatacccagatcatcatccaggaggagagcggcatccccaaggtcgcagacccctggggcggctcctacatgatggagtgtctcaccaacgacgtgtacgacgccgccctgaagctgatcaacgagatcgaggagatgggggggatggccaaggccgtagccgagggcatccccaaactgaggatcgaagagtgcgccgcccgccggcaggcgaggatcgacagcggcagcgaggtgatcgtgggggtgaacaaataccagctggagaaggaggatgccgtcgaggtgctggccattgacaacacctcggtccggaacaggcagatcgagaagctcaagaagatcaagagcagtcgagaccaggccctggccgagaggtgcctggccgccctgacagaatgcgcagccagcggcgacggaaacatcctggcgctggccgtggacgccagtcgggccaggtgcacggtgggcgagatcaccgacgccctgaagaaggtcttcggggagcacaaggccaacgaccggatggtgagcggcgcctaccgacaggagttcggcgagtcaaaggagataacctccgccatcaagagggtgcacaagttcatggagagggagggcaggaggcccaggctcctcgtcgccaagatgggacaggacggccatgacaggggcgccaaggtcatcgccaccggattcgccgacctgggcttcgacgtggacatcgggcccctgtttcagaccccacgggaggtggcccagcaggccgtggacgccgacgtgcacgcggtgggcgtcagcaccctggccgctgggcacaagaccctcgtgcccgaactgatcaaggagctgaactccctggggaggcccgacatcctcgtgatgtgcgggggggtgatccccccccaggactatgaattcctgtttgaggtgggggtgagcaacgtgttcggccccgggactagaatacccaaggccgccgtccaggtgctggatgatatcgagaaatgcctggagaaaaaacagcaaagcgtg

SEQ ID NO: 181 - DNA, 2250 bp, Artificial Sequence
  Codon optimized sequence that encodes an MCM polypeptide with the I671V mutation
atgctgcgggccaagaaccagctgttcctgctgagcccccactacctgcggcaggtgaaggagagcagcggcagccggctgatccagcagaggctgctgcaccagcagcagccgctgcacccggagtgggcggcgctggcgaagaagcagctgaaggggaagaacccggaggacctgatctggcacacgccggaggggatcagcatcaagccgctgtacagcaagagggacacgatggacctgccggaggagctgccgggggtgaagccgttcacgagggggccgtacccgacgatgtacacgttcaggccgtggacgatcaggcagtacgcggggttcagcacggtggaggagagcaacaagttctacaaggacaacatcaaggcggggcagcaggggctgagcgtggcgttcgacctggcgacgcacagggggtacgacagcgacaacccgagggtgaggggggacgtggggatggcgggggtggcgatcgacacggtggaggacacgaagatcctgttcgacgggatcccgctggagaagatgagcgtgagcatgacgatgaacggggcggtgatcccggtgctggcgaacttcatcgtgacgggggaggagcagggggtgccgaaggagaagctgacggggacgatccagaacgacatcctgaaggagttcatggtgaggaacacgtacatcttcccgccggagccgagcatgaagatcatcgcggacatcttcgagtacacggcgaagcacatgccgaagttcaacagcatcagcatcagcgggtaccacatgcaggaggcgggggcggacgcgatcctggagctggcgtacacgctggcggacgggctggagtacagcaggacggggctgcaggcggggctgacgatcgacgagttcgcgccgaggctgagcttcttctgggggatcgggatgaacttctacatggagatcgcgaagatgagggcggggaggaggctgtgggcgcacctgatcgagaagatgttccagccgaagaacagcaagagcctgctgctgagggcgcactgccagacgagcgggtggagcctgacggagcaggacccgtacaacaacatcgtgaggacggcgatcgaggcgatggcggcggtgttcggggggacgcagagcctgcacacgaacagcttcgacgaggcgctggggctgccgacggtgaagagcgcgaggatcgcgaggaacacgcagatcatcatccaggaggagagcgggatcccgaaggtggcggacccgtggggggggagctacatgatggagtgcctgacgaacgacgtgtacgacgcggcgctgaagctgatcaacgagatcgaggagatgggggggatggcgaaggcggtggcggaggggatcccgaagctgaggatcgaggagtgcgcggcgaggaggcaggcgaggatcgacagcgggagcgaggtgatcgtgggggtgaacaagtaccagctggagaaggaggacgcggtggaggtgctggcgatcgacaacacgagcgtgaggaacaggcagatcgagaagctgaagaagatcaagagcagcagggaccaggcgctggcggagaggtgcctggcggcgctgacggagtgcgcggcgagcggggacgggaacatcctggcgctggcggtggacgcgagcagggcgaggtgcacggtgggggagatcacggacgcgctgaagaaggtgttcggggagcacaaggcgaacgacaggatggtgagcggggcgtacaggcaggagttcggggagagcaaggagatcacgagcgcgatcaagagggtgcacaagttcatggagagggaggggaggaggccgaggctgctggtggcgaagatggggcaggacgggcacgacaggggggcgaaggtgatcgcgacggggttcgcggacctggggttcgacgtggacatcgggccgctgttccagacgccgagggaggtggcgcagcaggcggtggacgcggacgtgcacgcggtgggggtgagcacgctggcggcggggcacaagacgctggtgccggagctgatcaaggagctgaacagcctggggaggccggacatcctggtgatgtgcgggggggtgatcccgccgcaggactacgagttcctgttcgaggtgggggtgagcaacgtgttcgggccggggacgaggatcccgaaggcggcggtgcaggtgctggacgacatcgagaagtgcctggagaagaagcagcagagcgtg

SEQ ID NO: 182 - DNA, 2250 bp, Artificial Sequence
  Codon optimized sequence that encodes an MCM polypeptide with the I671V mutation
atgctgcgggccaagaaccagctgttcctgctgagcccccactacctgcggcaggtgaaggagagcagcggcagccggctgatccagcagcgcctcctccaccagcagcagcccctccaccccgagtgggccgccctcgccaagaagcagctcaagggcaagaaccccgaggacctcatctggcacacccccgagggcatctccatcaagcccctctactccaagcgcgacaccatggacctccccgaggagctccccggcgtcaagcccttcacccgcggcccctaccccaccatgtacaccttccgcccctggaccatccgccagtacgccggcttctccaccgtcgaggagtccaacaagttctacaaggacaacatcaaggccggccagcagggcctctccgtcgccttcgacctcgccacccaccgcggctacgactccgacaacccccgcgtccgcggcgacgtcggcatggccggcgtcgccatcgacaccgtcgaggacaccaagatcctcttcgacggcatccccctcgagaagatgtccgtctccatgaccatgaacggcgccgtcatccccgtcctcgccaacttcatcgtcaccggcgaggagcagggcgtccccaaggagaagctcaccggcaccatccagaacgacatcctcaaggagttcatggtccgcaacacctacatcttcccccccgagccctccatgaagatcatcgccgacatcttcgagtacaccgccaagcacatgcccaagttcaactccatctccatctccggctaccacatgcaggaggccggcgccgacgccatcctcgagctcgcctacaccctcgccgacggcctcgagtactcccgcaccggcctccaggccggcctcaccatcgacgagttcgccccccgcctctccttcttctggggcatcggcatgaacttctacatggagatcgccaagatgcgcgccggccgccgcctctgggcccacctcatcgagaagatgttccagcccaagaactccaagtccctcctcctccgcgcccactgccagacctccggctggtccctcaccgagcaggacccctacaacaacatcgtccgcaccgccatcgaggccatggccgccgtcttcggcggcacccagtccctccacaccaactccttcgacgaggccctcggcctccccaccgtcaagtccgcccgcatcgcccgcaacacccagatcatcatccaggaggagtccggcatccccaaggtcgccgacccctggggcggctcctacatgatggagtgcctcaccaacgacgtctacgacgccgccctcaagctcatcaacgagatcgaggagatgggcggcatggccaaggccgtcgccgagggcatccccaagctccgcatcgaggagtgcgccgcccgccgccaggcccgcatcgactccggctccgaggtcatcgtcggcgtcaacaagtaccagctcgagaaggaggacgccgtcgaggtcctcgccatcgacaacacctccgtccgcaaccgccagatcgagaagctcaagaagatcaagtcctcccgcgaccaggccctcgccgagcgctgcctcgccgccctcaccgagtgcgccgcctccggcgacggcaacatcctcgccctcgccgtcgacgcctcccgcgcccgctgcaccgtcggcgagatcaccgacgccctcaagaaggtcttcggcgagcacaaggccaacgaccgcatggtctccggcgcctaccgccaggagttcggcgagtccaaggagatcacctccgccatcaagcgcgtccacaagttcatggagcgcgagggccgccgcccccgcctcctcgtcgccaagatgggccaggacggccacgaccgcggcgccaaggtcatcgccaccggcttcgccgacctcggcttcgacgtcgacatcggccccctcttccagaccccccgcgaggtcgcccagcaggccgtcgacgccgacgtccacgccgtcggcgtctccaccctcgccgccggccacaagaccctcgtccccgagctcatcaaggagctcaactccctcggccgccccgacatcctcgtcatgtgcggcggcgtcatccccccccaggactacgagttcctcttcgaggtcggcgtctccaacgtcttcggccccggcacccgcatccccaaggccgccgtccaggtcctcgacgacatcgagaagtgcctcgagaagaagcagcagtccgtc

SEQ ID NO: 183 - DNA, 2250 bp, Artificial Sequence
  Codon optimized sequence that encodes an MCM polypeptide with the I671V mutation
atgctaagagcaaagaaccagctttttctattgtccccccattatttgagacaagttaaggaaagttcaggctccagacttatccaacagcgacttctccaccagcagcagccactgcatccggaatgggccgccctggcaaagaagcagcttaagggaaagaatcctgaggatttaatctggcacacccctgagggcattagcatcaagcccttgtactcgaagagggatactatggacctgcctgaggagctcccaggcgtgaagccgttcacccgcggcccctacccaaccatgtacactttcaggccctggaccatccgacagtacgccggtttttccacagtggaagaatctaataaattctataaagataacataaaggccggacagcaggggcttagcgtggcattcgatctggccacgcatcgcggatacgacagcgataacccaagagttagaggtgatgtgggtatggccggagttgccattgatactgtcgaagacacaaagattctcttcgatggcatccctctggagaaaatgagtgtgtccatgactatgaacggagccgtgattccagtcctcgctaattttattgtgacgggagaagaacagggggttcccaaggagaaacttacggggaccattcagaacgatatccttaaagaattcatggttcgcaacacatacatcttcccaccagagccttctatgaaaattatcgcagatatattcgagtacacggccaagcacatgcccaaattcaacagcattagtataagcgggtaccacatgcaggaggcgggggcagacgccattttggaactggcatacactttggccgacggcctcgaatactctaggacgggtctgcaggcggggctcaccatcgatgaattcgccccccgtctttcgttcttttggggcataggaatgaacttctacatggagatagctaaaatgcgggccgggaggcgcctgtgggcacatctgatagagaagatgtttcaacccaaaaactctaaatctttgttgctgagggctcattgccaaacctcaggctggtccctgaccgaacaggacccctacaacaatatcgttagaaccgcaatagaggccatggctgcagtcttcgggggaacccagtctctgcacaccaatagcttcgacgaagccctaggccttccaaccgtcaagtctgccaggatcgcacgtaacacgcaaattatcatacaggaagaatctggcatccctaaagtggctgacccttggggggggtcctatatgatggagtgcttgaccaacgacgtttacgatgctgctctaaagctgatcaatgaaatcgaagaaatgggcggcatggccaaagctgtcgccgaaggcatcccaaagttgcgtatagaggagtgcgcggcaagaaggcaggctcggatagattccggatccgaagtgatagtgggcgtcaataagtatcaactcgagaaagaggacgctgtcgaggtgttggccatagacaacacaagcgtgcgcaaccggcagatcgaaaaactaaaaaagattaaatcatcaagggaccaggccctggccgagaggtgtctcgcagccttgaccgaatgcgcagcttcaggggatgggaatatcttggctctcgccgtggacgcatctcgtgctaggtgtacagttggtgaaattacagacgcactcaaaaaggttttcggagagcataaggcaaacgaccggatggtgtcaggagcttacagacaggagtttggggaaagcaaggaaatcacctcagccatcaaacgtgtgcacaagttcatggaaagagagggtcggcggccacggctccttgttgccaagatgggccaagacggccacgaccggggagctaaggtgattgcaaccggatttgcagacctcggctttgatgtcgatattggaccactcttccagactccccgagaggttgcccagcaggctgtggacgccgacgtgcatgcagtgggagtttcaaccctggctgctggacataagactcttgtcccagagctaattaaggagttgaattctctcggcagaccagacattttagtgatgtgtggtggcgtcattcccccccaagactatgagtttctcttcgaagtcggagtctcaaatgtatttggaccaggtactcgcatccccaaagctgctgttcaggttctcgacgatatcgaaaaatgtctagagaaaaaacaacaaagcgtg

SEQ ID NO: 184 - DNA, 2250 bp, Artificial Sequence
  Codon optimized sequence that encodes an MCM polypeptide with the I671V mutation
atgctgagggctaaaaaccaactgttcctgctatccccccattacctgcgacaagtaaaggaatcttctggttcccgccttattcaacaaaggttgctacatcagcagcagcccttacaccctgagtgggccgctctcgctaagaagcagctgaaagggaagaaccccgaagaccttatatggcacacccctgagggaatcagcatcaagccgctgtattctaaaagggataccatggacttgcccgaggagcttcccggagtgaagcctttcactaggggcccctatcctacgatgtatacatttcgcccatggacaattagacagtatgcaggattcagtacagttgaagagtcaaacaaattctataaggacaatataaaggccgggcagcagggactgagcgtggcctttgatctggccacccataggggttacgacagtgacaaccctagggtgcgtggcgacgtaggaatggccggggtggcaatcgataccgttgaggacacgaaaatacttttcgacggaatccccctcgagaaaatgtctgtgtctatgacaatgaacggcgccgtgatccccgttctggcaaattttattgtcacgggagaagagcagggcgtgccaaaggagaaactgacgggaacaattcaaaacgacatccttaaggagttcatggttcgaaacacctacattttccccccagagccaagtatgaagataatagccgacatcttcgagtacacggcaaagcacatgcccaaattcaatagcatctcaatcagtggatatcatatgcaggaagctggtgctgacgctatcctcgagcttgcttacaccctcgcagacggactggaatatagtcggaccgggttgcaagctggtcttactatagacgaatttgctccacggctgtcattcttttgggggattgggatgaatttttacatggagatcgcaaagatgcgcgcaggaagacgcctctgggcccacctaatcgaaaaaatgttccagcctaagaacagcaagagcctcctgctcagagcccactgccagacctccggctggtctcttacagagcaggacccgtacaataacattgtgcgcaccgccatcgaggccatggctgccgtctttggtggcacccaaagcctccatactaatagcttcgatgaggcgctgggactcccaaccgtgaagtccgccaggatagctaggaacacccagatcatcatacaggaagagtctggaatccccaaggttgccgacccctggggcggttcctacatgatggaatgtctcaccaatgatgtgtatgatgccgctctaaaattaataaatgaaatcgaggagatgggcggcatggccaaagctgtcgctgaggggatcccgaaactgagaattgaagaatgcgccgctcgccggcaagctcgcatcgattcagggtccgaagtaatcgttggggtgaacaagtaccagctcgagaaagaggacgctgtggaggtcctcgccatagataatactagtgtgcgaaaccgtcagattgagaagctgaagaagataaaatcctcgcgtgaccaggccttggccgagagatgcttggccgctctcaccgagtgcgccgcaagcggggatggcaatatcctcgccctggctgtggatgcaagcagagctaggtgcacagtaggggaaattactgacgcccttaaaaaagtatttggagagcacaaggcaaatgatcgcatggtctccggagcctatcggcaagagttcggcgaatccaaagagattacgagtgccatcaagcgggtccacaaattcatggagcgagaagggcggcgcccaaggctgctcgtggccaagatgggccaggacggacatgacaggggagctaaggtgatcgctaccggtttcgccgacctggggtttgatgtcgacatcggtcctctgttccagactcctagggaagtcgcacagcaggccgtggatgccgatgttcatgccgtcggagtgtctactctggcggctggccataaaactctggtccccgagctgatcaaggagctgaattctctgggccgcccagacatcctcgttatgtgcgggggggtcatcccacctcaggactacgaattcctcttcgaagtgggagtcagcaacgtgtttgggcccgggacccgtataccaaaggctgccgtgcaggtgctggatgatattgaaaagtgtctggaaaaaaagcagcagtccgtg

SEQ ID NO: 185 - DNA, 2250 bp, Artificial Sequence
  Codon optimized sequence that encodes an MCM polypeptide with the I671V mutation
atgctgagggccaaaaaccaactgtttctgctcagccctcattatctgaggcaggtcaaggaatcatccggtagccgactgatacagcagcgacttctccatcagcaacaaccacttcacccagagtgggccgcccttgcaaagaaacagttaaaaggaaagaaccctgaagatctcatctggcacacacccgagggcatctcaataaagccgctgtactcgaaacgagacaccatggacctgcctgaagaactgccgggggtcaagccctttactagagggccctacccaaccatgtacacatttcgcccttggactattcggcaatacgccggcttcagtacggtagaagagtccaataagttttataaagataatattaaagccggacaacaaggactgtcggtggcattcgacctggctacacatagggggtacgatagtgacaatcctagagtccgcggtgatgtggggatggctggcgtggcaatagacaccgttgaggacacgaaaatcctgttcgatggtatccctttagagaaaatgtccgtttctatgacgatgaacggggctgtgatccccgtcctagccaatttcatcgtcacgggcgaggaacagggggttccaaaagaaaaattgaccggaactatacaaaatgacatactgaaggaattcatggttcgcaacacttacattttccctcctgagccttctatgaagataatagccgacatttttgagtacactgctaagcatatgcctaagttcaacagcatctcaatatcggggtaccacatgcaggaggctggagccgacgcgattctcgaattggcgtacaccctcgcggacggtctggagtactctaggactggcctccaggccggacttactattgatgagtttgccccgagactgtccttcttttggggtataggaatgaacttttacatggagatcgctaaaatgcgcgcgggcagaagactgtgggcccacctgatcgagaaaatgtttcaacccaagaactcaaagagcttgttattgagggcccattgtcaaacctcagggtggtcactgactgaacaggacccatataacaacatcgtccgcactgctatcgaggctatggccgctgtcttcggcgggactcaaagtcttcacacaaactctttcgacgaggctctgggtctacccaccgtgaagagcgcccgtatcgcgcgcaatacccaaatcatcatccaggaagaaagtggtatccccaaggtggcagacccatggggcggcagctacatgatggaatgtctgaccaacgacgtctatgacgccgctctgaaactgattaatgagatcgaggagatgggtggcatggctaaggcggtcgcggaggggatcccaaagttacggatcgaggagtgcgccgcacgacggcaagcccgaatcgattcaggttcagaggtcattgtgggggtgaacaaataccagttagaaaaagaggatgctgtggaagtgctggccatcgacaatacatctgttcgcaaccggcagatagagaaattgaaaaaaattaagtcatctcgagaccaggccttagcagaacggtgcctggctgcactgaccgagtgcgctgcgtctggtgatggaaacatactagcgcttgccgttgacgccagccgtgcacgctgtacagtaggggaaattacagacgcattaaagaaggtatttggggagcacaaggcgaacgaccgcatggtgtccggggcctaccggcaggagttcggagagtcaaaggaaatcacctctgccatcaagcgcgtgcacaagtttatggagagggagggcaggcggcctcgtctccttgtcgctaaaatgggtcaggacggtcatgaccgaggggccaaggttattgcgaccggtttcgcggatctgggcttcgacgtggacatcgggccactctttcagaccccaagggaagtagcccagcaagccgtggacgcagacgtacacgctgtcggagtgagcacactggctgccgggcataagacattggtgcctgaattgataaaagagctgaactcactagggcgacctgatatcctcgttatgtgcggcggcgttattcctccacaggactacgaatttctcttcgaggtcggtgtttccaatgtttttggtcccgggactagaatccctaaggcagctgtccaggttctggacgacatagagaagtgccttgagaagaaacaacagtccgtt

SEQ ID NO: 186 - DNA, 2250 bp, Artificial Sequence
  Codon optimized sequence that encodes an MCM polypeptide with the I671V mutation
atgctaagggcaaaaaaccagcttttcttgctgagcccgcattacctgagacaggtgaaggagagctccgggtctcggctgatccagcagagacttctgcaccagcagcagcctttgcacccagagtgggctgctctggccaaaaaacagctgaagggtaaaaacccagaagatctcatctggcacactccagagggcatatcaatcaaaccactctattcaaagcgagacacaatggacttgccagaagagctcccaggggttaaacctttcaccagaggaccttacccaacgatgtacaccttcaggccttggaccatccgccagtacgcgggcttcagcacagtggaggagagtaacaagttctacaaggataacatcaaggcgggccaacaaggtctctccgtggccttcgaccttgccactcacagagggtatgactccgacaatccccgcgtgaggggagacgtgggaatggcgggggtggcaattgacactgtcgaagacaccaagatcctgtttgacggtatccctttagaaaaaatgtcagtgtccatgacaatgaacggagcagtgatacccgttctcgccaacttcatcgttactggagaggagcagggggttccgaaggaaaagctcaccggcacgatccaaaatgatatcctcaaggaattcatggtccgcaacacatatattttcccaccagaaccaagtatgaaaattatagccgatatcttcgaatacactgcaaagcatatgccgaagtttaacagtatctccatcagcggctaccacatgcaggaggctggggccgacgccatccttgaacttgcctacaccctcgccgatggcctggaatactcccgcaccgggctgcaagccggtctgactatcgacgagttcgcccctcgcttgagtttcttttggggtataggcatgaacttttacatggagatagctaaaatgagggctgggcgccggctctgggcccacctgatagaaaaaatgtttcagccaaagaattccaagtccctcctcctgagggcgcactgccagacctctggatggtctttaaccgagcaagatccatataataacatcgtgaggaccgcgattgaagccatggcagcagtctttggaggcacccagtcactgcacaccaactctttcgacgaggcgcttggattacccaccgtgaagtccgcgagaatagccagaaatacacaaattataattcaagaggagtcggggattcctaaagtggccgacccttggggcgggtcatacatgatggaatgtttaactaatgacgtgtacgatgccgcattaaaactgattaacgagatcgaggaaatgggagggatggcaaaggctgtggccgaggggattccaaaactgcggattgaggagtgtgcggctagacgccaggctaggattgactcaggatcagaggtgatcgtgggggtgaataaataccagctggagaaagaggatgcagttgaagtcttagccattgataacactagtgttagaaatcgccagattgaaaaactgaagaaaatcaaaagctccagagatcaggctctagctgaacggtgcttagcagcactgaccgaatgcgccgccagcggcgacgggaatattctagcgcttgccgtagacgccagcagagcccgctgtactgtaggtgagataactgatgcattgaaaaaagtgttcggtgaacacaaggccaatgatcggatggtcagcggggcctaccggcaagagttcggcgaaagcaaggaaattacgagcgcaataaagcgtgtgcataaatttatggagagagaaggacgccggcccaggctgctggttgctaaaatgggacaggatggccacgacagaggcgcgaaggtaatcgcgaccggatttgcagatcttggcttcgatgtggatattggcccactgtttcagaccccccgagaggtcgctcaacaagcggtggacgccgatgtgcacgctgtgggcgtgtctacgctcgctgccggacataagacacttgttcctgaactcattaaggaacttaattctctgggccgcccagatatccttgtgatgtgcgggggagtgattcctccgcaggactatgagttcctgtttgaggttggtgtatctaacgtctttggccccggcacacggattcctaaagcggcggtgcaggtgcttgatgacatcgagaagtgccttgagaaaaaacagcagtccgtt

SEQ ID NO: 187 - DNA, 2250 bp, Artificial Sequence
  Codon optimized sequence that encodes an MCM polypeptide with the I671V mutation
atgctgagagctaagaaccaactgttcctgctgagccctcactacctgaggcaggtgaaggaaagctccgggtccaggctgatccagcaacggctcctgcaccagcagcagccactccatcccgagtgggccgctctggccaaaaagcagctcaagggcaaaaaccccgaggacttaatttggcacactcctgagggaattagcatcaagcctctgtacagcaagagggacaccatggacctccccgaggagctgcctggggtaaagcccttcactaggggcccctaccccaccatgtacacattcagaccctggactatcagacagtacgccggcttctctactgtcgaagagagcaataagttctacaaagacaacatcaaggcaggccagcagggcctctccgtcgcattcgacctggccacgcacagggggtatgacagcgataaccccagggtgcggggcgacgtaggaatggcgggagtggccattgacaccgtggaggataccaaaatcctcttcgatggcattccactcgagaagatgtctgtgagcatgaccatgaacggggccgtgatccccgttttggctaacttcatcgtcaccggggaggagcagggcgtacccaaggagaagctgacaggcaccatacagaacgacatcctgaaggagttcatggtccggaatacatacatctttcctcccgagccctctatgaagatcattgccgacatcttcgagtacaccgccaagcacatgcccaagtttaactcaatatccattagcggatatcacatgcaggaagcaggggccgacgccattctggagctggcctacacactggctgacggactggagtacagccggaccggcctacaggccggcttgaccatcgacgagttcgcccctaggctctcttttttctgggggatcggcatgaatttctacatggagatcgccaagatgagagcggggcggcgtctgtgggcccacctgatcgagaagatgtttcagccaaaaaactcaaaatcactgctgctccgcgcccactgtcaaacaagcggctggtcccttaccgagcaggacccctacaacaacattgtgcggactgctatcgaggccatggccgccgtgttcggcggaacccagagcctgcataccaactctttcgacgaggcccttggtctgcccaccgtgaagagcgccagaatcgcaagaaacacccagattatcattcaggaggaaagtggcattcccaaggttgccgacccctggggcggcagctacatgatggagtgccttactaatgacgtgtacgacgccgccctgaagctgatcaacgagatcgaggagatgggtggcatggctaaagctgtggctgagggaatccctaagcttcggattgaagagtgcgccgccagaagacaggctagaatcgactccggatccgaggtaatcgtcggggtgaacaagtatcaactggagaaggaggacgcggtggaagtcctcgctatcgacaataccagcgtcaggaaccgccagattgagaagctgaagaagatcaagtcttccagggaccaggcgctggccgaaaggtgcctggccgccctgaccgaatgcgccgccagcggcgacggcaacattctggctctggctgtggacgccagccgtgccaggtgcactgtgggagagatcacagacgctctgaagaaggtgtttggagagcacaaggccaacgacagaatggtgtcaggcgcctataggcaggagtttggcgagtccaaggagatcacaagcgccatcaaaagagtacataagtttatggagcgtgagggaagaagaccacgcctgctggttgccaagatgggccaggatggccacgacagaggggctaaggtgatagccactggcttcgccgatctgggtttcgatgtggatatcggacccctctttcagaccccaagagaggtggctcagcaagccgtggacgcagacgtgcacgccgttggggtaagcaccctggccgccggccacaagaccttggtgcctgagctgatcaaggagctcaattcccttggccgcccagatatcctggtaatgtgtggcggcgtgatcccacctcaagactacgagttcctgtttgaggtgggggtgtccaacgtgttcggccccgggaccagaattcccaaggccgcggtccaggtgctggacgacatcgaaaaatgcctggagaaaaaacagcagagcgtg

SEQ ID NO: 188 - DNA, 2250 bp, Artificial Sequence
  Codon optimized sequence that encodes an MCM polypeptide with the I671V mutation
atgcttagagccaaaaatcagctttttcttctgtccccccactacctccggcaggtcaaagagtctagcggatcacgtctaatccagcagaggctgctccaccagcagcagcccctccaccctgagtgggcagcgttagcgaaaaagcaactgaagggaaagaaccctgaagatctgatatggcatacaccagagggtattagcatcaagcctctgtactcaaagcgcgacactatggatctccccgaggagttacctggagtgaagcccttcacaagaggaccatatcccactatgtacacatttagaccttggactatacgtcagtacgccggttttagcaccgtcgaagaaagtaacaaattttacaaagacaacatcaaggctggacaacagggcctgagtgttgccttcgacctcgctacacaccggggctacgactcagataatccaagggtgcgcggcgatgtgggcatggccggagtggccatcgatacagtcgaggataccaagattctctttgacggcattccacttgagaagatgtccgtcagcatgacgatgaatggtgccgtgattccagtgctcgccaattttatagtgacgggcgaagaacagggtgtgcctaaggaaaaactgaccggcacgattcaaaacgatatcctgaaagagttcatggttaggaatacttatatcttcccacctgaaccaagcatgaagataatcgccgatatttttgaatatactgccaaacatatgcctaagttcaacagtatttcaatttccggatatcacatgcaagaggctggcgcagatgcaatattggagctagcatacaccttagccgacggtttggaatatagtaggaccgggctccaggcagggctgacgatagacgagttcgcaccacggctgtcattcttttggggaattgggatgaacttttacatggagatcgcaaagatgcgggcaggccgtcggctctgggcccacttgattgagaagatgttccaaccaaagaacagcaagtcgcttctcctgagggcacactgccagaccagcggatggtccttaactgagcaagatccgtataataatatcgtgaggacagcgatcgaggccatggccgctgtcttcggtggaactcagagcctgcacactaattcctttgacgaggcactgggtctgcccacagtgaagagcgccagaatcgcccgcaatacgcagatcattatccaagaagagtccggcattcccaaggtagcagacccatggggcggctcatacatgatggaatgtttgacaaacgatgtgtatgatgccgctcttaaactgatcaacgaaattgaagagatgggcgggatggccaaggcagtcgccgagggcatccccaagctgaggattgaggaatgcgcagccagaagacaggcccgtatcgattcaggaagcgaagtgatagtgggcgtcaataaatatcagctggagaaggaggacgccgtcgaagtgctcgctatagacaataccagcgttaggaatagacagatcgaaaagcttaagaaaattaaatcgtccagggaccaggcattagccgaacgatgcctggcggccctgactgaatgcgctgcatccggcgatggcaatatcctcgcactcgcggtggatgcctcacgggccaggtgtaccgtgggagagatcacggacgctcttaagaaagtgtttggcgagcacaaagcgaacgatcgcatggtatccggggcttatcgccaggaattcggagaaagtaaggagatcaccagcgctattaaaagagtgcacaagtttatggagcgtgaaggtcgcaggcctagactgttagtggccaaaatggggcaggatgggcacgatcgtggcgcgaaagttattgccaccggtttcgcagaccttggcttcgatgttgacattgggcccctttttcagacccctcgggaggttgcccaacaggctgtcgatgcggacgtgcacgcggttggcgtgtcaaccctggctgccgggcacaaaacgctggttccagaactgatcaaagagctcaattctctaggtaggcccgacatcctggtgatgtgtggcggggtgattcctcctcaggattacgaattcctctttgaggtgggcgtgtcaaacgtctttggcccaggcacacgaatcccaaaagccgccgtacaagtattagatgatatcgagaaatgcctcgaaaaaaaacaacagtccgtc

SEQ ID NO: 189 - DNA, 2250 bp, Artificial Sequence
  Codon optimized sequence that encodes an MCM polypeptide with the I671V mutation
atgcttcgcgcgaagaatcaactgttcctcctgagtccacattacctgagacaggtgaaggagtctagcggcagcagactgatacagcaaaggcttctgcatcagcaacagccacttcatccagaatgggccgccctagcaaagaaacaattgaaaggcaagaatcctgaagatctcatctggcacactcctgagggcatcagtatcaaaccgctctactcaaaaagggatactatggatttacctgaagaactgcccggagtgaaaccatttactaggggcccatatccaaccatgtatacatttcgtccatggactatcaggcaatacgccggcttctctacagtggaggagtcaaataagttttataaggataatattaaggcagggcagcagggcttgtctgtggcattcgatctggcaacgcaccggggatatgatagtgataaccctagggtgagaggagacgtgggtatggctggggtggctatcgacaccgtagaggacaccaaaattctgtttgatggaatcccattagagaagatgagcgttagcatgacaatgaatggggcagtgatccccgtgctggcaaattttatcgtaaccggcgaagagcagggcgtgcccaaagaaaagttaacgggtactattcagaacgatatcctgaaggaatttatggtcagaaacacttatattttccctccagagccaagcatgaagattattgccgatatcttcgagtacaccgccaagcacatgccaaaattcaacagcatctccatcagtggctaccacatgcaggaagctggcgctgacgccatcctggaattggcctatacgctagcggacggattggaatatagtaggactggacttcaagccggcctcacaattgacgaattcgcgcccagactgagttttttctggggaattggcatgaatttctacatggagatcgctaagatgcgagccggccgacggctctgggctcaccttatcgaaaaaatgttccagcccaagaactctaagtccttactgctgagggcccactgccagacttcgggatggtccctgacagaacaggacccatacaacaacattgtcagaacagctatcgaggcaatggccgccgtgttcggtgggacacagtcactccacacaaactctttcgacgaggctcttggactgccgacagtgaagagtgccaggatagccagaaatacacagattattatccaggaagagtctgggatacctaaggttgcagatccctggggggggtcttatatgatggaatgcctcaccaacgacgtctacgatgcagcattgaagcttatcaatgaaatcgaagaaatgggtggaatggctaaggctgtagccgaaggaattcctaagctcagaatcgaagaatgcgcagctcggcgccaggcccggatagactctggctctgaagtgattgtaggggtcaacaagtaccagctagagaaggaggacgccgtcgaggtattggcaattgacaacaccagcgtccggaatagacagatcgaaaaactcaaaaagatcaaatcctctagggaccaagctctggcagagcgatgtctcgctgccctgacagaatgtgcggccagtggcgatggaaacatcctggctctggccgtcgacgcaagtagagcgagatgcactgtgggggaaatcaccgatgcactgaagaaggtatttggggaacataaagccaacgataggatggtttcaggtgcatatcgacaagagtttggagaaagtaaggaaatcaccagcgctatcaaacgcgtgcataagtttatggagcgcgagggacgtagacctcgcttactggtggcgaagatgggacaggacggacacgacagaggcgctaaagtgatcgccacaggattcgcggatctcggcttcgacgtcgacatcggtccactgttccagactccgcgtgaagttgcgcagcaggctgttgacgctgatgtacatgctgttggggttagcacattagcggcaggacataagacccttgtgcccgagctgataaaagagctcaattcccttggcagaccagacattctggtgatgtgtggtggcgtcatcccacctcaagattacgaatttttatttgaggttggggtgtccaatgtctttgggcccgggactcgcataccgaaagctgccgtgcaggtgctcgacgatatcgagaagtgcctcgagaagaaacagcaaagtgtg

SEQ ID NO: 190 - DNA, 2250 bp, Artificial Sequence
  Codon optimized sequence that encodes an MCM polypeptide with the I671V mutation
atgctgcgagctaagaaccaactttttctgctttctcctcactatcttaggcaagtgaaggaaagttcaggctcacgtctgatccaacagagactgttgcaccagcagcagcctttgcacccggagtgggctgcactggcaaagaaacagctgaaagggaaaaacccagaggacctaatttggcacactcccgaaggaatcagcatcaagcctctctactccaaaagggacacaatggacttgcccgaagaacttcccggcgtgaaacctttcaccagaggcccttaccctacaatgtacactttcagaccctggacgatcaggcagtatgcaggcttctccactgttgaagaaagcaacaaattctataaggacaacataaaagccggacagcaggggctgtccgtggccttcgatctggccacgcatcggggttatgacagcgataaccctagagttaggggagatgttggaatggccggtgtggccattgacactgtggaagatacaaagatactgtttgatgggatccccctcgaaaagatgtcggtctcaatgacaatgaacggggcagttattccagtgcttgcaaacttcattgtgactggagaagagcagggggtccccaaagagaaactgacaggaaccatacagaacgacattctgaaagagttcatggtccggaatacctatatttttccgccagagccgtccatgaaaatcattgcagatatttttgaatacactgccaagcacatgcctaaatttaatagcatcagcatcagtggctaccacatgcaggaagcgggagctgatgccattctagaactcgcgtacaccctcgcagatgggttggaatatagcagaacaggcctccaggcggggctcacaattgatgaatttgcacccaggctgtcgtttttctggggaatcggtatgaacttctatatggaaattgcaaagatgcgcgctggcagaaggctgtgggcacacctcatcgaaaaaatgttccagcctaagaacagcaagagcctgctgctgcgggcgcactgccagacctctggctggagtctgacagagcaggatccttataacaatatcgtgcgtaccgccattgaggctatggccgctgttttcggtggcacgcagtccctccacacaaacagctttgatgaggctctgggccttcctactgtcaaaagcgcaagaatcgcacgcaatacacagataataatccaggaagagtcaggcattccaaaggtggccgacccatgggggggcagctatatgatggagtgccttacaaatgatgtgtacgacgcggcactgaagttaattaatgagattgaagaaatgggggggatggctaaggcagtggcggagggtatacccaagctgagaatcgaagagtgtgccgctcgcagacaagctaggatcgacagcgggagtgaagtcatcgtcggagtaaacaaatatcagcttgagaaggaagatgctgttgaggtgttggcgatcgacaacaccagcgtgcggaatagacagatcgaaaagctgaagaagattaagtctagccgcgaccaggctctggcagagcgctgtctggccgcgctaactgagtgtgcagccagcggggacggaaacattctcgccctggctgtcgacgcaagccgcgcacggtgcacagtaggggaaattaccgacgctctcaagaaagtcttcggtgagcacaaggcaaatgaccggatggtaagcggagcttataggcaggaattcggagaaagcaaggaaatcacttctgctattaagcgtgtgcacaaatttatggaacgcgaagggagacgcccacgcttgcttgtggccaagatgggacaggacggccacgatcggggtgctaaagtcattgcgacagggtttgctgatctcggatttgatgtggatataggcccacttttccagaccccacgagaggtcgctcagcaggcagtggacgccgatgtgcacgctgtgggcgtgtccaccctggccgccggacacaaaactcttgtccccgagcttattaaagagctgaatagtcttgggcggcccgatattcttgttatgtgtggaggggttattcctcctcaggactatgagtttctgttcgaagtcggcgtgtccaatgtatttggccccggaacacgtataccaaaagcggctgtacaggtgttggatgacatcgaaaaatgtctggaaaagaaacagcagagtgtg

SEQ ID NO: 191 - DNA, 2250 bp, Artificial Sequence
  Codon optimized sequence that encodes an MCM polypeptide with the I671V mutation
atgctacgggccaagaatcaattatttttgctttccccacattacctccgccaggtcaaagaaagctccggcagcagacttattcagcaaaggctcctgcaccagcagcagccccttcaccccgaatgggcagcgctagccaagaaacagctaaaggggaagaatccagaagatctgatatggcacaccccagaggggatcagtatcaagcctctatactccaaaagggacactatggacctgcctgaggaattaccaggcgtgaaaccctttacccggggcccttaccccacgatgtacacttttaggccttggactatccgccagtacgcgggattttctacagtcgaagaaagcaacaaattctacaaggataatatcaaggccggacagcaaggcttgagcgttgccttcgatttagcaactcacaggggctatgacagcgacaatcctagggttaggggggacgtgggcatggcaggagtggccatcgacacagtggaagacaccaaaattttgttcgatggaattcctctggaaaaaatgtccgtgagtatgactatgaatggggctgttatccctgtcctggcaaatttcattgtcaccggggaggaacagggcgtacccaaggagaagctgacaggtaccatccaaaacgatatcctgaaggagttcatggtaaggaacacctacatcttccctcccgaaccttccatgaagataatcgccgatatctttgaatacaccgccaagcatatgcctaaattcaattctatttccatctccgggtaccacatgcaagaagcgggagccgatgctattttggagctggcatatacattagcagacggcctcgaatactcacgaacaggtttgcaggcaggtctgactatcgacgagttcgcccccaggctttcatttttttggggcatcggcatgaacttctacatggagatcgctaagatgagggcaggacggagactatgggcccacctgatcgagaagatgttccagcccaagaattctaaaagcctactcctgcgggctcactgtcagacttccggttggtctctgactgagcaggacccgtataataatatcgtaagaacagcaatcgaagctatggcagctgttttcggcggtacacagtctctgcacaccaacagctttgacgaggcgctggggcttccaaccgtaaaaagtgcacggatcgcgcggaacacacagatcattatccaggaagaatccggcattccgaaggtggccgatccttggggtggcagttatatgatggagtgcctaacgaatgatgtttacgacgctgcccttaagctcattaatgaaatcgaggagatgggaggaatggctaaagctgtggcagaggggatcccaaagctccgaatcgaagaatgtgccgctcggagacaggcaaggatcgattccggaagcgaagtcattgtgggggtcaacaagtatcagttagagaaggaagatgctgtggaggtactggctattgacaatacgtctgtgaggaatcggcaaatcgagaaactgaagaagatcaaatcctctcgagaccaagccctggccgaaagatgcctagccgccttaaccgaatgcgcggccagtggggatggcaatattttagccctggctgtggatgcatccagagccagatgcacagtgggtgagatcacggacgcgctcaagaaggtgtttggcgaacataaagccaatgatagaatggtcagcggggcctacaggcaggagtttggcgaaagcaaagagattaccagcgccatcaaacgcgtccacaagtttatggagagggaagggcgacggcctcgcctcttagtggccaaaatgggccaggacggtcacgacagaggcgctaaggtgatcgcgacaggctttgcggacctaggctttgacgtggatattggtccactgttccagacaccccgtgaagtcgcacagcaggctgtggatgctgatgtgcatgcagttggggtttcgactctcgccgcaggtcacaaaaccctggtccccgaattaattaaggaactgaatagcctgggaagacccgatatcctggttatgtgcggcggggttattcctccccaggactacgaattcctttttgaggttggcgtctcaaatgtgttcggcccaggaacgaggattcccaaagctgcagtccaggtgcttgacgatatagagaagtgtctggagaagaaacaacagtccgtg

SEQ ID NO: 192 - DNA, 2250 bp, Artificial Sequence
  Codon optimized sequence that encodes an MCM polypeptide with the I671V mutation
atgctacgggctaagaaccagctcttcctactttcccctcattacctcagacaagtaaaagaaagttcgggatcccgcctgatccagcagcgcctgctgcaccagcagcagcccctccatcctgagtgggccgccttggctaagaagcaactgaaagggaaaaacccagaggatttgatatggcatacgcctgagggcatatctataaaaccactgtactcgaaaagagacactatggacttgcccgaggagctccccggtgttaaacctttcacccgagggccatacccgaccatgtacactttccgtccctggaccattcggcagtacgcagggttcagcacagtagaggagtctaataagttctacaaggacaacattaaagccggtcagcaggggctgagcgtagccttcgacctagcaacgcaccggggctatgactctgataaccctagggtgagaggagacgtaggaatggctggcgtggcaattgacactgtggaagatacaaagatcttatttgacggaattccccttgaaaagatgtctgtttctatgaccatgaacggcgccgtgataccagtactcgcaaatttcatagttaccggagaagaacaaggagttcccaaggagaaactcacgggtacaattcaaaatgacattctgaaagaattcatggttaggaacacttacatcttcccacccgaaccctctatgaagattattgctgatatattcgaatacacagctaaacacatgcctaaatttaattccatctccatcagtggctaccatatgcaggaagcaggcgcagacgccatcttggagctggcttacactctcgctgacgggctcgaatattctcgtacggggcttcaggcagggctcaccattgacgagttcgctccacgtctctcatttttctggggcataggcatgaatttctacatggagatcgctaagatgagggccggcaggaggctctgggcccatctgatagagaaaatgttccagcccaaaaactccaaatcactgcttctgagagctcattgccagactagcggctggagcctgaccgaacaagacccctacaataatattgtaagaactgcgatcgaagccatggccgccgtgtttggcggcactcagtccttgcacaccaattcattcgatgaagccttaggcctgccaactgtgaagtcagcccgcatcgctcggaatacgcagatcatcattcaggaggagagcggaatccccaaagtcgccgatccctggggaggctcctacatgatggaatgtcttacgaatgacgtctatgatgcggccctaaagctaataaacgagattgaagagatgggcgggatggccaaggccgtggctgaaggaattccaaagctcaggatcgaagaatgtgccgcccgccgccaagctagaattgattccggtagtgaggttattgtaggagtcaacaagtatcagctggaaaaggaggatgccgtagaagtgcttgccatagataatacgtccgtgcgaaatcgccaaatcgaaaagttgaagaaaattaagagcagtcgcgaccaggccctcgccgagaggtgcctcgctgctctcacggagtgcgccgcttctggcgacggcaatatcctcgccctggctgtggacgcatccagggctcgttgtaccgtgggtgaaataacggatgccctgaagaaggtgtttggtgagcacaaagccaacgaccgcatggtgagtggcgcctacagacaggagtttggggaatctaaagagatcacctctgctataaaaagagtgcataaatttatggaaagggaaggtaggaggcccaggcttctggtggccaaaatggggcaggacgggcacgaccgcggtgccaaagtcattgccacaggctttgccgacttgggattcgacgtggatattgggccactgtttcagactccacgtgaagttgcgcagcaggccgtcgacgccgatgtgcacgcagtgggagtttccaccctggcagcagggcataaaaccctcgtgcctgaactcattaaggaactaaacagtctgggcagaccagatatcctggtaatgtgtggaggcgtgattcccccccaagattacgagttcttgttcgaggtgggcgtcagtaacgtgttcgggcctggtacgcgaattcccaaagctgcagtgcaagtgctcgacgatattgaaaaatgcctagagaagaagcagcagagcgtg

SEQ ID NO: 193 - DNA, 2250 bp, Artificial Sequence
  Codon optimized sequence that encodes an MCM polypeptide with the I671V mutation
atgttgcgtgccaagaatcagctcttcctgctgtcccctcactacctccggcaggtcaaggagtcttcaggtagtagactcatccagcagagattgctgcaccagcaacaacctttacaccccgaatgggcagcgctagcaaagaaacaactcaagggaaaaaaccctgaggacttaatttggcatacgcccgaggggatttcgatcaaacctttatacagcaaacgcgatactatggacttgcctgaggaactgcccggcgtgaagccctttaccaggggtccctaccccactatgtatacatttcggccttggactattcggcagtacgctggatttagcaccgtcgaggaaagtaacaagttttacaaggacaacatcaaggcaggtcagcagggactcagcgtcgcattcgacttagcaactcaccgcggttatgatagtgataatcctcgagtgcgaggcgatgtgggaatggcgggagtggctatcgacaccgtcgaggacaccaagatcctgtttgacggtatcccactggagaagatgtccgttagcatgactatgaacggcgccgtcattccagtgctggcaaattttatcgttactggagaggagcagggggtgccgaaagagaagttgaccggtactattcaaaatgacatcttaaaggagttcatggtccggaatacatacatctttccccccgagccatcgatgaagatcatcgccgacatttttgagtacacggcaaaacacatgcctaagtttaacagtatatccatttccggttatcatatgcaggaggccggcgctgacgcaatcctggaattggcctatacattagcagatggcctggaatatagtcggaccggcttgcaagcgggcctaaccatcgacgagtttgctccaaggctcagtttcttttgggggattgggatgaacttttatatggaaattgccaagatgcgagctggtagacggctgtgggctcatttaattgagaagatgtttcagcccaagaattctaagtcccttctcctgcgggcccactgtcagaccagtgggtggtctctcacggaacaggacccttataataacattgttcggacagcgattgaagccatggctgcagtttttggcggaactcagtctctgcacaccaattccttcgatgaagctctcggactcccgaccgtcaagtctgcccggatcgcccgcaacacgcaaatcatcattcaggaagagagcggaatcccgaaggtcgccgacccgtggggcggaagttacatgatggaatgtctgaccaacgatgtgtatgatgcggctcttaaactgatcaacgaaatcgaggagatgggcggcatggctaaggccgtcgcagagggcattcctaagctgcgtatcgaggaatgtgctgctagacgccaggcacggatcgacagcggctccgaggtgatagtgggtgtgaacaaatatcaactcgagaaggaggacgccgttgaagtactggctatcgacaacacaagcgtacgtaatagacagatcgagaagctgaagaagatcaagtctagtcgcgaccaggccctggctgaaagatgtctagctgccctaacagagtgcgctgcatccggcgatggcaatatacttgccttggccgttgatgctagtagggccagatgtactgtgggtgagattactgacgcccttaaaaaagtctttggggagcacaaagcaaacgaccgtatggtatcaggtgcttaccggcaagaatttggggaaagcaaagaaattacctctgctatcaagagggtgcacaagttcatggagcgtgaaggaagacgtccccgcctgcttgtcgctaaaatgggccaggatggtcatgatagaggcgccaaagtgattgcgaccggctttgccgatttggggttcgatgtggacataggcccactattccagacccctagagaagtcgcccagcaggctgtcgatgctgacgtccacgctgtgggggtgagcacccttgccgccggacataaaactctggtgcctgagcttattaaagaactcaatagcctgggccgccctgatatcctagtcatgtgtggcggagttatacctccgcaggactacgagttcctgtttgaggtcggggtgtctaacgtctttgggccgggaacccgcatcccaaaagctgcggtgcaggttctggacgacattgagaaatgcctggagaagaaacaacagtcggtt

SEQ ID NO: 194 - DNA, 2250 bp, Artificial Sequence
  Codon optimized sequence that encodes an MCM polypeptide with the I671V mutation
atgcttcgggcgaagaatcagctttttctactctcccctcattacctccgacaggtgaaagagagcagtggatcaagactcattcaacaacgtctgcttcatcagcagcagcctttacatcccgaatgggctgctctggccaagaagcagctgaaaggaaaaaatccggaggacttaatctggcacacacccgagggaatctcaattaagcccctgtattctaagcgagacactatggatctccctgaagagctgccaggggtgaaaccttttacacgcggaccctaccccacaatgtacacatttcggccatggacgattcggcaatacgcagggtttagcacggtggaagaatcaaataagttctacaaggacaatattaaggcaggccaacagggccttagcgtcgctttcgatctcgccacccacagagggtacgattcagacaatcctagggtcaggggagatgtagggatggccggagttgcgatagacaccgtcgaggacaccaagatcctgtttgatgggatcccgctggaaaagatgagcgtgtctatgacaatgaatggagctgtgattcctgtgttggccaattttattgtgacaggcgaggagcagggagtgcctaaggagaagctgactggtacgatccagaacgatattctcaaagaatttatggtgcggaacacgtacattttcccacccgaacctagcatgaaaatcatcgccgatatattcgagtatacagcaaaacatatgcccaaattcaattccatatctatcagcggttatcacatgcaggaggcgggtgccgacgcaatcctggagctggcttacaccttggctgacggcctcgaatatagcaggacaggccttcaagcagggctcacgattgatgagttcgcgcctcgattgtccttcttctgggggattggcatgaatttttatatggaaattgcaaagatgcgggcaggacgacgactctgggcacacctaatagagaaaatgtttcaacctaaaaatagcaagagcctgctgttacgcgcccattgccagactagcgggtggtccctgactgaacaagacccgtataacaacatagtgagaactgcaatcgaagccatggccgccgtgttcggagggacccagagtctgcacacgaatagttttgacgaggccctgggcctgccgaccgttaaatccgcgcggatagccaggaatacccagatcatcattcaagaagaatctgggatccctaaagtcgccgatccctgggggggcagttacatgatggagtgcctcactaatgacgtgtacgatgccgcattgaagctgattaacgagatcgaagaaatgggcgggatggccaaggccgtagcagaaggcatccccaaattgcggattgaagaatgtgctgcgcgtagacaggcgcgtatcgattctggatcagaagtaatcgtgggggtgaacaagtaccagctcgagaaagaagacgctgtcgaagtcctggctatcgacaatacttcagtcaggaaccggcagatcgagaagctgaaaaagattaaatccagtcgcgaccaagccctggcggagcggtgtcttgctgcactgacggagtgcgctgcgagcggtgatggcaatatcctggccctggcagtggatgctagtcgcgccaggtgcacagtgggggagattaccgacgctctcaaaaaggtcttcggtgaacacaaagccaacgacagaatggtgagcggcgcttaccggcaggaattcggtgagtctaaagagataactagcgctatcaaacgcgtccacaaattcatggagcgagagggcagaagacctaggctgctggtggcgaaaatgggtcaagacggacacgataggggggctaaggtcatagcaaccggtttcgctgatcttggatttgatgttgacataggtcctcttttccaaaccccgcgtgaggtggctcagcaggctgtggatgcggatgtccatgctgttggggtctcaacactggccgctggccacaaaacacttgttcctgaactgataaaggagctgaacagcctgggtcgtccagatattctggttatgtgcgggggcgttatccctccccaagactatgagttcctgttcgaggtcggcgtaagtaatgtgtttgggcccgggacccgtatccctaaagccgcagtgcaagtgcttgatgacattgagaagtgcttagagaagaaacagcaatcggtg

SEQ ID NO: 195 - DNA, 2250 bp, Artificial Sequence
  Codon optimized sequence that encodes an MCM polypeptide with the I671V mutation
atgctgagagccaaaaaccagctgttcctcctcagcccgcactacctaaggcaggtaaaggagagcagcggatcaagactcatccagcagaggctgctgcaccagcagcaaccgctgcaccccgagtgggccgcactcgccaagaagcagctgaaaggcaagaacccggaggacctaatctggcacacccccgaagggatcagcatcaagccgctatactccaaaagagacacaatggacctacccgaggagctccccggagtgaaaccattcacccgcgggccctaccccacgatgtacacgttccggccctggaccatcaggcaatacgccggcttctcaaccgtggaggagagtaacaaattctacaaagacaacatcaaagcgggacagcagggcctctcagtggccttcgacctcgcaacacaccgcggctacgactcagacaaccccagggtgcgcggggacgtcggaatggccggagtcgccatcgacacagtcgaggacaccaagatcctgttcgacgggatccccctggagaaaatgagcgtgagcatgaccatgaacggggccgtgataccagtgctggccaacttcatcgtaacaggagaggagcagggggtgcccaaagagaagctcacagggacaatccagaacgacatcctgaaggagttcatggtacgaaacacctacatcttcccccccgagcccagtatgaagataatcgcggacatattcgagtacaccgccaagcacatgccgaagttcaactcgatcagcatctcaggctaccacatgcaagaggcaggggcggacgcaatcctggaactggcctacacactagccgacgggctggagtacagccgaaccgggctgcaggcgggcctcaccatagacgaattcgccccacggctgagcttcttctgggggatcgggatgaacttctacatggaaatcgccaagatgagagcaggcaggcgactgtgggcccacctaatcgaaaagatgttccaaccaaagaactccaaaagcctgctcctccgggcacactgccaaacaagtggatggagtctgaccgaacaggacccatacaacaacatcgtgcggacagccatagaggccatggccgcggtgttcgggggcacccagagcctccacaccaacagtttcgacgaagccctggggctaccaaccgtcaaatcggcccggatcgcaagaaacacacagatcatcatccaggaggagtcggggatcccaaaagtggcggacccatggggcgggagctacatgatggaatgcctgaccaacgacgtctacgacgccgccctaaaactgatcaacgaaatagaagaaatgggcgggatggccaaggccgtggccgagggcatcccgaagctccgcatcgaggagtgcgcagcgcgacggcaggcgaggatcgactcaggaagcgaggtcatagtaggcgtcaacaaataccagctcgaaaaagaggacgcagtggaagtgctggcaatcgacaacacctccgtccgcaacaggcagatcgagaaactcaaaaagatcaagagctcacgggaccaggccctcgccgagagatgcctcgcggccctaaccgaatgcgcagccagtggcgacggcaacatcctggccctagcagtcgacgccagcagggccaggtgcaccgtgggggaaatcaccgacgcgctgaagaaggtgttcggagagcacaaggccaacgaccgcatggtgagcggggcctacaggcaggagttcggcgaaagcaaggagatcaccagtgcaataaagagggtccacaagttcatggaacgagaaggccgccggccaagactgctggtggcgaaaatgggccaggacgggcacgaccgaggcgcaaaggtaatcgcaacggggttcgccgacctggggttcgacgtcgacatcggacccctgttccaaacccccagggaagtggcccagcaggcagtggacgccgacgtgcacgccgtgggcgtatcgaccctggccgcgggccacaaaacgctggtcccggagctcatcaaggagctgaacagtctgggccgcccagacatcctggtcatgtgcggcggggtgatacccccgcaggactacgagttcctattcgaggtcggagtctcgaacgtgttcgggcccggcacacgcatcccaaaagccgcagtccaggtcctggacgacatcgaaaagtgcctggaaaagaaacagcagtcagtc

SEQ ID NO: 196 - DNA, 2250 bp, Artificial Sequence
  Codon optimized sequence that encodes an MCM polypeptide with the I671V mutation
atgcttcgggcaaaaaatcaactcttcctgcttagtccacactacctacgacaggtaaaagagagctctggttcccggttaatccagcagagactgctccatcagcaacagcccctgcaccccgaatgggcggctctcgctaagaagcaattaaagggcaagaacccagaagacctgatttggcatacaccggaaggaatcagtatcaaacccctctatagcaaaagagatacgatggatctccccgaggaactgcccggagtgaagcccttcacgcgcggtccatacccaactatgtatacgtttcggccctggacgatccggcagtacgccggcttttctaccgtcgaggagtctaataaattttacaaggacaatatcaaggctggccaacagggcttgtcggtagcctttgatctggccactcaccgtggatatgacagcgataatccacgggtgcggggggacgtcggtatggccggtgtagccatcgacaccgtagaagataccaaaatcctctttgatgggatccccctcgagaagatgtccgtgtcaatgaccatgaacggtgctgtgatccctgtgctcgccaacttcatagttaccggggaagagcagggggtgcctaaggaaaagttaaccgggacaatccaaaatgacatcctcaaggagtttatggtgcggaatacttatatattcccacccgagccttcaatgaagatcatcgctgatatcttcgagtacactgctaaacacatgcccaagtttaattctattagtatctcagggtaccacatgcaggaggctggtgcagacgccattctggagttggcttacacactggcggacggtctcgagtattctaggacgggactccaggccggacttaccatcgacgagtttgcccctaggctgtcattcttttggggtatcgggatgaatttttacatggaaatcgctaaaatgcgggccgggcgccggttatgggcccaccttattgagaaaatgtttcagcccaaaaattctaagtctctgctcctaagggcacattgccaaacttcgggctggtcgcttaccgaacaggacccatacaacaacattgtccgcaccgcaatcgaggccatggctgctgtgtttgggggtactcagtctctacacaccaactccttcgatgaagcactcggtctgccgactgtgaaaagcgccagaatcgcccggaatacccaaataataatccaggaggagtccgggattcctaaagtcgcagatccttgggggggctcttatatgatggagtgcctgaccaatgacgtgtacgacgccgccctgaagctaatcaatgagatcgaggaaatgggagggatggccaaagcagtggctgagggaattcctaagctgaggattgaagagtgtgcagctcggcgacaagcgcggatcgacagtggcagcgaggtcatcgtcggagtgaacaagtatcagttagaaaaagaggatgctgtggaggtgcttgctattgataacacatcggtccgcaatagacaaatcgagaagctgaagaaaattaagagcagtcgcgaccaggcattggccgagaggtgcctcgccgccctgacagagtgtgccgcaagtggagatggaaacatacttgctctggccgttgatgcttccagagcccgctgcactgtaggagagattaccgatgcgttgaagaaggtgtttggagaacataaagccaatgaccgaatggtgtcaggagcttaccgccaggaattcggggagagtaaagaaataacaagcgcaatcaagcgcgtgcacaaattcatggaaagagaggggcggagacctcgactattggtggcgaagatgggccaagacgggcacgatcggggggccaaagtgattgctacgggattcgctgaccttggcttcgatgtggatattggccccttgttccaaacgccaagagaggttgcccaacaggccgtggacgccgacgtgcacgcagtgggcgtgtccaccctggccgcaggccataagacactcgttccggaactaattaaagaattgaattccctgggcagacccgacatactggtaatgtgtggcggagttatccccccgcaggactacgagttcttgtttgaagtgggtgtgtccaatgtgttcgggcctggtacccgaatcccgaaagcggccgtacaggttctggacgatatcgaaaaatgcttggaaaaaaagcaacagagcgta

SEQ ID NO: 197 - DNA, 2250 bp, Artificial Sequence
  Codon optimized sequence that encodes an MCM polypeptide with the I671V mutation
atgctccgggccaaaaaccagctgtttttgctgagcccccactacctgcggcaagtcaaggaatcttcaggttctcgcctgatacagcaacgtctgctgcaccaacagcagcccctgcatccagagtgggcagccctggcaaagaaacagctgaagggaaaaaatcccgaggatcttatctggcatacaccagaagggatctcgatcaaaccactgtacagtaagcgggataccatggacttaccggaggagctgcccggtgtcaagccatttactcgaggcccgtatcccaccatgtatacttttcggccatggacaatacgtcagtatgccggatttagcacagtggaagaaagtaacaaattttacaaagataacataaaggctggccagcaaggcctctccgtagctttcgatctggctacgcataggggttatgatagtgacaatcctagggtgcggggggatgtcggtatggctggcgtggcaattgacaccgttgaggacaccaagatcctctttgatgggattcccttggaaaaaatgagtgttagcatgacaatgaatggagctgttatccccgtgcttgccaattttatagtcaccggggaggagcaaggggttcctaaagagaagctaacagggaccattcagaatgacatcttgaaagaatttatggtgaggaatacatacatcttccccccagaaccgtccatgaagatcatcgccgatatcttcgaatatacagcaaaacatatgccgaaattcaattctatttccatcagcggctatcacatgcaggaggctggagcagacgccatcttggagttggcctacacattggctgacggccttgagtactctaggacaggcctgcaggcaggtcttacaattgacgagttcgcccctcgccttagttttttttgggggatcggcatgaacttttatatggagattgccaaaatgagagcgggaagaaggctttgggcccacctaatcgagaagatgtttcagcccaaaaattctaagtctctgctgctgcgcgctcactgtcagaccagtggctggtccctaacggagcaagatccatataacaacatagttcgtactgccatagaagccatggccgcagtattcggaggaacgcaaagcttgcacaccaattcattcgacgaagctctaggcctgccgacagtgaagtcagcccggattgctcgtaacacgcagatcatcatccaagaagaatccggaatcccaaaagtggcggatccttggggtggatcctacatgatggagtgcttgaccaacgatgtgtatgacgctgccctgaagctaatcaatgagatagaggagatgggggggatggccaaagccgtagcagaagggattccaaaactccgcatcgaggagtgcgctgcgaggcgacaggcccggatagatagtggatccgaggtcattgtgggagtcaacaagtaccagctcgagaaggaggacgcagtggaagtccttgccatagacaatacctctgtccgaaatcggcagatcgaaaaactcaagaaaataaaatcttcaagggaccaggctctcgccgagcgttgcctcgcggcactgaccgagtgcgcagcaagcggcgacgggaacatcctcgctcttgctgtggatgcctcccgggcccgatgcactgtcggagagatcactgacgcactgaaaaaggtttttggggagcataaggcgaacgaccgcatggtgtccggggcctacagacaggagtttggtgaatccaaagaaattacaagcgcaataaaacgggtccacaagtttatggagagggagggtcgtcgccctaggctcttggtggctaagatggggcaggatgggcatgaccggggggctaaggtgatcgctactgggttcgcggacttgggatttgacgtggacattggacctctgttccagaccccacgcgaggtcgcgcagcaagccgtggatgcggatgtccacgctgtcggcgtgtccacactggctgccggccataagactttagtgcccgaattgatcaaggagttgaactcactcggaaggcccgatatcctggtgatgtgcggcggtgtcatcccaccacaggactatgaatttctgtttgaggtgggggtctccaacgtattcgggccgggaacaagaattccgaaagcagcggtgcaagtgctcgacgatatcgaaaagtgtcttgaaaaaaagcagcagtcggtc

SEQ ID NO: 198 - DNA, 2250 bp, Artificial Sequence
  Codon optimized sequence that encodes an MCM polypeptide with the I671V mutation
atgttgcgcgcaaagaaccagctatttcttttaagtccacactatctgcgtcaggtgaaggagagttctgggagtagacttatccaacagagactcttacaccagcaacagccccttcatccagaatgggctgcactggctaaaaagcagctgaaaggaaaaaatccggaggacctcatctggcacacacctgaagggataagcattaagccactctacagcaagagggacacgatggatctcccagaggagcttccaggggtaaaaccgtttacacgcggaccctacccaaccatgtacacgttccgaccatggacaatcagacaatacgccggttttagcactgtggaggagtcaaacaagttctataaagataatatcaaagccggacaacagggactttccgtggcctttgacctggccacacaccggggctacgactctgacaacccaagagtccggggcgacgttggcatggccggtgtggccatcgacactgtcgaggacaccaagatcctgttcgatggcattcccttggaaaaaatgagcgtgtctatgaccatgaacggggcagtaatacccgtccttgcaaacttcatcgtgaccggggaagagcagggcgttcctaaggaaaaactgacggggacaattcagaacgacatcctgaaggaatttatggtgcgaaatacgtacatattcccccctgagccgtccatgaagataattgccgacattttcgaatacactgcaaagcacatgcccaaatttaactccataagcatcagtggctatcacatgcaagaggccggggcagatgctatcttggaacttgcctacactctcgcagatggattagagtactccagaacaggtctgcaggctggcctgacaatcgacgaattcgcccccagactatcttttttttggggtatagggatgaatttctatatggagattgccaagatgagagctggaagacgtctctgggcccacctaatcgaaaaaatgttccagcccaagaatagcaagagtctgctcctccgcgctcactgccagacatcgggctggtctctgactgaacaggatccttataataacatcgtcaggactgccatcgaggccatggccgccgtgtttggagggacccagtccttgcacactaacagcttcgacgaggctttgggtctgcctacggttaagtccgcccgcatagctcggaacactcagatcatcatccaggaggaatcaggaattcctaaggttgccgacccatggggcggaagttatatgatggaatgtctcacaaatgatgtttatgacgctgctctgaagctgattaatgagatagaggagatgggtgggatggcaaaagctgtggctgagggaatccctaagctcagaatcgaggaatgtgcagccagacggcaggcaagaatcgattccggctccgaagtgatagtgggggttaataagtatcagcttgagaaggaggatgcagtggaggtgctggcgatagacaatacctcggtaagaaataggcagatagaaaaactcaagaagatcaagtcatctcgcgatcaggccctggccgaacgttgcctggcagcactcaccgagtgtgccgcatcaggggacggaaacatcctcgcattagcggtcgatgcaagtagagcgcggtgtacagtcggcgaaatcactgacgcgttgaaaaaggtcttcggggagcataaggctaacgaccgcatggtgagcggcgcttaccgccaagaattcggagagtctaaagagattaccagcgccattaaacgggttcataaatttatggaacgggaaggacgacgccctcggttgctggtggcaaagatgggacaggacggccacgacagaggcgcgaaagtcattgctacaggtttcgcagacctcgggttcgatgtggacataggccctctttttcagactccacgtgaggtggcacaacaggccgtcgatgcagacgtccatgccgtaggggtgtcaaccctggctgctggacacaagacccttgtaccagagctgatcaaggagttgaacagcttagggcgtcctgatattctcgtgatgtgtgggggagtgatcccaccgcaagattacgagttcctgttcgaggtgggcgtgagcaatgtgttcgggcctggcaccagaataccgaaggcagcggtccaggtcttggacgacatcgagaagtgcctcgaaaaaaaacagcaaagcgtg

SEQ ID NO: 199 - DNA, 2250 bp, Artificial Sequence
  Codon optimized sequence that encodes an MCM polypeptide with the I671V mutation
atgctgagagccaaaaaccagctctttctgttgtccccccactatctgcggcaagttaaggagagttccggctcacgcctgatacaacagagactgctccatcagcaacagccgctgcacccagaatgggcagccctggccaaaaaacaacttaaaggtaagaacccggaggatttgatctggcacacacccgaaggaatttccatcaagcctctatattctaaaagagatacgatggatctgccagaggagttaccgggggtgaagccgtttacacgcgggccctatcctacgatgtacacgttcaggccctggaccatcaggcagtacgcaggtttcagcacagttgaggagagcaacaagttttacaaggacaatattaaggccggccagcaaggcctttcggtagccttcgaccttgcaacacatagggggtatgattccgacaaccctagggtcaggggcgatgttggaatggccggagtcgcgatagacacagtggaagacacgaagatcctgtttgatgggatccctctggagaaaatgagtgtctccatgaccatgaacggcgcggtgatccctgttctggccaatttcattgtgaccggtgaggaacagggggtccctaaggagaaattgacgggcactattcagaacgacatcctcaaagaatttatggttcgcaacacctacattttccctcccgagcccagcatgaaaattatcgcagatatctttgaatatactgcaaagcacatgcctaagtttaattctatcagcattagtggctaccatatgcaggaggccggagccgacgccattctcgagctggcatataccttagccgatgggctagagtattcgcgaacaggtctgcaggcaggacttacaatcgacgaatttgccccacgcttgagctttttttggggtatcggcatgaacttctacatggagattgcgaagatgcgagcaggaaggagactgtgggcccacctcattgagaagatgtttcagcctaaaaactctaagtcattactcctgcgggctcattgtcagaccagtggctggagccttaccgagcaggacccgtacaataatattgttcgcacagctattgaggcgatggccgccgtgttcgggggcacgcagtcccttcacacgaactcattcgatgaagcactgggcctgcccaccgtcaagtctgctcgaattgcccggaatacacagataattatacaggaggaatctggcatcccaaaggtggctgacccgtgggggggtagctatatgatggaatgcctgactaatgacgtgtacgatgctgcgttgaaactgataaatgagattgaggagatgggtggcatggcaaaggcggttgctgaggggatcccaaagctccgcatcgaggagtgcgctgccagaaggcaggcgcggattgattccggctctgaggttatcgtcggggtgaacaagtatcaattggaaaaagaagacgccgtggaagttcttgccatcgacaacacaagtgtgagaaatcgacagatcgagaagttgaagaagatcaaatcatcccgggaccaggcattggccgaacgctgcctggccgctttgaccgaatgtgcggccagcggggacgggaacatcctcgccctcgcagtcgatgctagcagagcccgctgcaccgtaggcgagatcaccgatgctctcaagaaagtcttcggggagcataaagccaacgatagaatggtctctggtgcatatcggcaggaatttggcgaaagcaaagaaataacgtctgccatcaagcgcgtgcataagtttatggaacgggaaggacggcgcccgagactgctggtagctaagatgggacaagatggacacgataggggggcaaaggttattgcaacaggtttcgccgacctcggatttgatgttgatattggtcctttattccagacaccacgcgaagtggctcagcaggcagtagacgccgacgtgcatgccgttggcgtttcaaccctggctgctggccacaagaccctcgtgcccgagctgataaaagaactcaacagcctggggaggccagacattctggtcatgtgcggaggagtgatccctcctcaggactacgaatttttgttcgaagtgggagtatcaaacgtctttggtcctggcacccgcatcccaaaggccgctgtccaggtcctggacgacattgaaaagtgtctggaaaagaaacaacaatcagta

SEQ ID NO: 200 - DNA, 2250 bp, Artificial Sequence
  Codon optimized sequence that encodes an MCM polypeptide with the I671V mutation
atgctgagggctaagaatcagctctttctgttgtccccacactatttacggcaggtgaaagagagcagtggttctaggctgatccagcagcggctcctgcaccagcagcagccattgcatcctgagtgggcggctctcgccaagaaacagctgaagggaaagaacccagaggatttgatttggcacactcccgagggcatcagcatcaaacccctgtattcgaagcgcgacacaatggacctccccgaagaactaccaggagtgaagccctttacgcggggaccctatcccaccatgtataccttccgcccgtggacgattcgccagtacgcaggtttctcaaccgttgaggaatcaaacaagttttataaagacaatatcaaggctggccagcagggactctccgtggcatttgacctggcaacccaccgtgggtacgattccgataacccccgcgtacggggtgatgttgggatggccggcgtcgctattgacactgttgaagacacgaagattctctttgacggaatcccgctggagaagatgagcgtttcaatgacaatgaatggagcagtgatccccgtcttggccaactttatagtgacgggggaggagcagggcgtgcctaaggagaaactgacaggcacaatccagaatgacatcttaaaagagttcatggttaggaatacctacatcttcccccccgaaccttcaatgaagatcattgccgatatcttcgaatacactgcaaagcacatgcccaagtttaactctatttccattagcggatatcacatgcaggaagccggagcagacgctatcctggaattggcgtacaccttagccgacgggttggaatattcccggacagggctccaggcggggctgacaatagacgagtttgcacccaggctgtccttcttctggggcataggaatgaatttctacatggagatcgctaagatgcgagctgggagaagactctgggcccacctcattgagaaaatgttccagcccaaaaacagcaaatccctgcttctgagagctcactgccaaacaagtggctggagtctcaccgaacaagatccgtataacaatatcgttaggacagcaattgaggcaatggcggcagtgttcgggggaacacagtccttgcacacgaatagttttgacgaggcactcggcctgcccacggtcaagtcggcacgaatagccaggaacacacagatcatcatccaggaggaatctggcattcccaaagtagccgatccatggggcggatcctacatgatggaatgtcttacaaacgatgtatacgacgccgctctgaagctcattaacgaaatcgaggagatgggaggtatggccaaagctgtggcggaaggaatcccaaagctccgaatcgaggaatgcgccgcccggcggcaagccaggatcgactcaggatcagaagtcattgtcggtgtcaacaagtatcaactggaaaaagaggatgcagtcgaagtgctggccatcgataatactagtgtccggaatcgccagattgaaaaactgaagaaaattaaatcctctcgcgaccaggcattggctgagagatgcctggcagcacttacagagtgtgccgccagtggggatggaaacatccttgctctggcagtggatgcctcccgcgcccgttgcactgttggtgagatcacggatgctctgaagaaggtgttcggcgaacacaaggcaaacgacagaatggtgagcggcgcctaccggcaggagttcggggaaagcaaagaaatcacctcagcaattaagagagtgcacaaattcatggaaagagaaggacgcaggcccagacttttggtggcgaagatgggacaagatggccacgaccgtggtgctaaagtaatcgcaacaggttttgcagatctgggcttcgatgtggatattggaccgctcttccagacgccacgcgaggtcgctcagcaagctgttgacgctgacgttcatgccgtgggggtctctacgctggctgccggccataaaaccctggtccctgagctgatcaaagagctgaatagtctcggtcggcccgacatcctcgtcatgtgcggcggagttataccccctcaggactacgagtttctttttgaagtgggggtctccaatgtcttcggcccgggaactcggattccaaaggctgccgttcaggtgctcgacgacatagaaaaatgtctggagaaaaagcaacaatcagta

SEQ ID NO: 201 - DNA, 2250 bp, Artificial Sequence
  Codon optimized sequence that encodes an MCM polypeptide with the I671V mutation
atgctgagagcaaagaatcagctgtttttgctgagcccgcactacctgcggcaagtaaaagagtcttctgggagcaggctaatacaacagcgccttctgcaccaacaacagcctctccatccagagtgggccgctcttgctaaaaagcaactgaagggcaagaacccagaggatcttatttggcacaccccggaggggatttccatcaagcccctctactccaaacgggacaccatggacctccccgaagaacttcccggcgtaaagccatttacacgaggtccctatccgacaatgtacacatttcggccgtggacaatccgacagtacgctggctttagcaccgtggaagaatcaaacaaattctacaaagataatatcaaagctgggcaacaaggactgtcagtcgcattcgaccttgctacacatcgaggatacgattccgataacccgcgcgtcagaggtgacgtaggaatggcaggggtggcgatcgacaccgtcgaggacacaaaaatattgttcgatgggattcccctggaaaagatgtccgttagcatgacaatgaatggagcagttattccggtgttggcaaatttcatagtgacgggtgaggagcagggtgtccctaaagagaagctaactggcacaattcagaatgatatcctgaaagaattcatggtgcgcaatacctatatctttcctccagaaccttctatgaagattatagcagacatatttgagtacaccgcaaaacacatgcccaagttcaactcgatttctatttctgggtaccacatgcaagaggccggagccgacgccatactggaactcgcctacactctcgcagatggactcgagtactcaaggacaggcttgcaggccgggctgacaatcgacgagttcgctcccagacttagctttttctggggcatcggcatgaacttttatatggaaatcgccaaaatgagggcaggccgacgtctatgggcccatctgatcgagaagatgttccaaccaaagaattccaagtccctactccttagggcgcattgccagacctccggatggagcctgaccgaacaggatccatacaataacattgttagaacagccatcgaagcaatggccgcagttttcggcggaactcagtcccttcatacaaatagcttcgacgaggcactgggtctgcctaccgtgaaatctgccagaatcgctcgtaatacccagataataatccaggaggaatcaggtatccctaaggtcgccgacccctggggggggtcttatatgatggaatgtctaaccaacgacgtctatgacgctgctctcaaactcattaatgaaattgaagaaatgggcggtatggccaaagctgtcgcagagggcattcctaagctgcgcatagaggaatgcgcagcaaggaggcaagcacggatcgattccggatctgaggtaatcgtgggcgtcaacaagtatcagttggagaaggaggacgccgtcgaggtcttggcaattgataacaccagcgttcggaatcgtcagatcgaaaaactgaaaaagatcaagtcttctcgagatcaggccttggcagagcgttgtctggctgctttaaccgagtgcgcagcctctggagacggaaatatcctggccctggccgtggacgcctcccgggcacgctgtacagtgggggaaattacagatgctctgaagaaagtattcggagagcacaaagcaaatgaccgaatggtctccggcgcctataggcaggaattcggcgaatcgaaagaaatcacctcagcgattaagagagtccacaaattcatggagcgcgaaggaaggcggccacgtttactcgtagccaaaatggggcaggacggccatgatcggggagctaaagtaatagcaaccggtttcgcagacctggggtttgacgtggacattggtccattgtttcagacccccagggaggttgctcagcaggctgtggacgcggacgtgcatgccgtgggagtgtcgaccctggctgcaggacacaaaacactagtccccgaactcattaaagagctcaactcactgggtcggcccgatatactggttatgtgtggtggggtgattcccccacaggactatgagttcttattcgaggttggtgttagtaatgtctttggaccagggaccaggattcccaaggcagcggtgcaagtgttagacgacattgaaaaatgcctggaaaagaagcagcagtcagtg

SEQ ID NO: 202 - DNA, 2250 bp, Artificial Sequence
  Codon optimized sequence that encodes an MCM polypeptide with the I671V mutation
atgctgcgcgcaaagaatcaacttttcctgctgtccccacactacctccgtcaagtgaaggagtcctccggcagcaggctgatccagcaacgactgttacaccaacagcagcctctgcacccagaatgggctgctttagcaaagaagcagctgaaaggaaagaacccagaagacctaatatggcacacgcctgaaggtatctccattaagcctctgtactcaaaacgggacactatggatctccctgaggagctgccaggcgtcaaaccgtttactcgcggtccttaccctactatgtacacattccggccatggaccatacgacagtatgctggattctctaccgtggaagagagcaataagttctacaaggataatattaaggcaggccagcagggactgagcgtagcgtttgatcttgccacacaccgtgggtatgactctgataatccacgagtaagaggggacgtcggtatggccggagttgcaatcgatactgtagaggatacaaaaattctctttgatgggataccgctcgagaagatgtccgtaagcatgactatgaacggtgccgtgatccccgtgctcgctaactttatcgtcaccggcgaagaacagggcgtgcccaaggagaaattgacaggtacaatccagaacgatattctaaaggagttcatggtgcggaatacatacatttttccacccgaaccctctatgaaaatcattgccgacatcttcgagtacaccgccaagcatatgcctaagttcaactctatttctataagcggctatcacatgcaggaagcaggtgccgacgccattctcgaactggcttataccttggcagatggactggaatattcaagaaccgggcttcaggccggtctcacaattgacgaatttgcgcctcgactgagtttcttttggggaataggtatgaatttctatatggaaatagccaagatgcgcgccggcagaaggctttgggcccatttgatcgagaaaatgtttcagccaaaaaacagcaaaagtctgctcttacgcgcccactgtcagacctctggctggtcgttgacagaacaggatccctataacaacatcgtacggactgctattgaggcaatggcagcagtgtttggcggaacccagagcctgcataccaattcatttgacgaagctctgggtctgccaactgtgaaatcagcccgcattgcccgcaacacccagattataatacaggaagaaagtggcattcccaaagtggcggatccttggggaggaagctacatgatggagtgcctgactaatgacgtatacgatgcggcgctgaaactgatcaatgaaatagaagaaatggggggaatggccaaggccgtggcggagggcatacctaaactaaggatcgaggagtgtgcagccagacgccaggctcgcatcgactccggaagtgaagttatagttggcgtgaataaatatcagttagagaaggaggatgccgtggaggtgctggcgatcgataataccagcgtccgcaataggcagatagaaaagttgaaaaagattaaatcgtcccgcgaccaggccctggccgaacgctgtctggccgcactcactgagtgtgccgcaagtggagatggcaatatcctcgctctagcagtggacgcctccagggcaagatgcaccgtgggagaaatcaccgatgccctgaagaaagtgttcggagaacataaagccaatgatcgcatggtgagcggggcgtatagacaggaatttggagaatctaaggagattacaagcgctatcaagagggtgcacaaatttatggaaagggaagggaggcgccccaggctacttgtggccaaaatggggcaggacggccatgacaggggcgccaaggtgatagccactggcttcgcggacttggggtttgatgttgatatcggccccctcttccaaacaccccgcgaggtggcgcaacaggcagtggatgccgatgttcacgcagtgggggtgagtacactcgccgcgggccacaagaccttagttcctgagctgataaaagagctcaattccctcgggaggcctgatatcctggtgatgtgcggaggagtcattcccccacaagactacgagtttttatttgaggtgggcgtttctaatgtcttcgggcctggaacccggatcccaaaagcagccgtacaggtgctggacgatattgaaaaatgccttgagaaaaagcagcagtccgtc

SEQ ID NO: 203 - DNA, 2250 bp, Artificial Sequence
  Codon optimized sequence that encodes an MCM polypeptide with the I671V mutation
atgctccgagcgaagaaccagctattcctgctcagcccgcactacctgcggcaggtgaaggagtcaagcggctcacgcctgatccagcagagactgctgcaccaacagcaacccctgcacccagagtgggcagccctggccaagaagcagctcaaggggaagaaccccgaagacctgatctggcacacaccagaagggatatccataaaaccactatacagcaaaagggacacgatggacctcccagaagagctgccaggcgtgaagcccttcacccgcgggccatacccaaccatgtacaccttcagaccatggacaatccggcagtacgcggggttctcaaccgtggaggagtccaacaaattctacaaggacaacatcaaagcagggcagcagggcctgagtgtagcattcgacctggcaacgcacaggggatacgactccgacaaccccagggtgcggggcgacgtgggcatggccggggtcgccatcgacacggtggaagacacaaagatcctgttcgacggcatccccctggagaaaatgtccgtgtcgatgacaatgaacggggccgtgatccccgtgctagcaaacttcatcgtcacaggggaggagcagggggtgccaaaagaaaaactgacaggcacaatccagaacgacatactcaaggagttcatggtcaggaacacctacatcttccccccagagccatcgatgaaaatcatcgccgacatcttcgagtacaccgccaagcacatgccaaaattcaactcgatctccatatcaggctaccacatgcaggaggccggcgccgacgccatactggagctggcgtacacgctggcggacggcctcgaatacagccggacaggcctgcaagccggactgaccatcgacgaattcgccccaagactgagtttcttctggggcatcgggatgaacttctacatggaaatcgcaaaaatgagagcgggccgacggctctgggcgcacctgatcgaaaagatgttccagccaaagaactccaagtccctcctcctcagagcccactgccagacatcaggctggtccctcaccgagcaggacccctacaacaacatagtgaggaccgccatcgaagcgatggccgcggtgttcggagggacgcagtccctgcacaccaacagcttcgacgaggcactcggcctgcccacggtcaaatccgcacgcatcgcccggaacacacagatcatcatacaggaggagagcggcatcccaaaggtggcagacccatggggcggctcatacatgatggagtgcctcacgaacgacgtgtacgacgccgcactgaaactcatcaacgaaatcgaagagatgggaggaatggcaaaggcggtggcggagggcatccccaagctgcgcatcgaggaatgcgccgcccggcggcaagcccggatcgactcaggatccgaagtgatcgtgggagtgaacaagtaccagctggaaaaggaggacgcagtggaggtcctcgcaatcgacaacacctcagtgcggaaccggcagatcgaaaagctgaaaaaaatcaaaagctcacgagaccaggccctggcagagcggtgcctggcagccctgacagagtgcgcagccagcggagacggaaacatcctcgccctggcggtggacgcctcgagagccagatgcaccgtcggcgagatcaccgacgcactgaaaaaggtgttcggagaacacaaggcaaacgaccgaatggtgagtggagcgtaccgccaggaattcggggagtccaaagaaatcacctcggcaataaagcgggtgcacaaattcatggaaagagaggggcggaggcccagactgctcgtggccaaaatgggccaggacggacacgacagaggcgccaaggtgatcgcgacagggttcgcggacctgggcttcgacgtggacataggcccgctgttccagacgccacgagaggtggcacaacaggcggtggacgccgacgtgcacgcggtgggggtgtccacactggccgcaggccacaaaacgctcgtacccgagctgatcaaagagctgaactcactgggacggcccgacatcctggtgatgtgcggcggagtgatcccaccacaggactacgaattcctgttcgaagtgggggtctccaacgtcttcggcccagggacaaggatccccaaggcagccgtgcaggtgctcgacgacatagagaaatgcctggagaagaaacagcaatcggta

SEQ ID NO: 204 - DNA, 2250 bp, Artificial Sequence
  Codon optimized sequence that encodes an MCM polypeptide with the I671V mutation
atgctaagagcaaagaaccagctgttcctgctgtcaccacactacctgagacaagtcaaggaaagttccggcagcagactgatccagcagcggctgctacaccaacagcagcccctgcacccagagtgggcagccctggccaaaaaacagctgaagggcaaaaacccagaggacctcatctggcacacaccagaggggatcagtataaagcccctgtacagtaaaagagacacaatggacctccccgaagagctacccggagtgaagccattcacacgagggccctacccaaccatgtacaccttccggccctggaccatcaggcagtacgccggcttcagcacagtcgaggagagtaacaaattctacaaagacaacatcaaggccgggcagcaggggctgtcagtggccttcgacctggccacacaccgggggtacgactcggacaacccgagggtgaggggggacgtgggaatggcaggagtggccatagacaccgtcgaggacaccaagatcctgttcgacggaatccccctggaaaagatgtcggtctccatgacgatgaacggcgccgtcatccccgtgctagccaacttcatcgtcaccggggaggaacagggagtgccgaaagagaaactgaccgggacgatccagaacgacatcctgaaagagttcatggtaagaaacacatacatattcccaccggaacccagtatgaagatcatcgcggacatattcgaatacaccgcaaaacacatgcccaagttcaactcgatcagcatatccgggtaccacatgcaggaagcaggggccgacgccatcctggaactcgcctacaccctagcagacggactggagtacagccgcaccggactgcaggcagggctgacgatagacgagttcgccccccggctgagtttcttctggggaatagggatgaacttctacatggagatagcgaagatgcgcgccggccgccggctgtgggcacacctgatcgaaaagatgttccagcccaagaactcaaaatcgctgctcctcagggcacactgccagacaagcgggtggagcctaaccgagcaagacccgtacaacaacatcgtccgaacagcaatcgaagccatggccgccgtcttcggcgggacacagagcctccacaccaactcattcgacgaagccctggggctgcccaccgtcaaatcagccaggatcgcccgaaacacccagatcataatccaggaagagtcggggatcccaaaggtagccgacccctgggggggatcctacatgatggagtgcctgaccaacgacgtgtacgacgccgccctgaagctgatcaacgagatcgaggagatgggaggcatggccaaggccgtggcggaaggaatcccgaagctgcgcatcgaagaatgcgccgccagacggcaggcccggatcgactccggatccgaggtgatcgtgggcgtcaacaagtaccagctggagaaggaggacgccgtcgaggtgctggccatcgacaacaccagcgtgcgaaacaggcagatagaaaagctcaaaaagatcaagtcatcgagggaccaggccctggcagagaggtgcctggcagccctgaccgagtgcgcggcctccggagacggcaacatactggccctcgccgtggacgcaagcagagcccgctgcaccgtcggagagataacagacgccctgaagaaagtgttcggggagcacaaggccaacgaccggatggtgagcggggcctacaggcaggaattcggggagagcaaggagatcaccagcgccatcaaacgggtgcacaaattcatggagagggaagggcgacgcccccgcctgctcgtggccaagatgggacaggacggccacgaccggggcgcaaaagtgatcgcaaccggcttcgcggacctgggcttcgacgtggacataggaccactgttccagacaccgagagaggtggcccagcaggcagtggacgcagacgtccacgccgtaggggtgtccacactggccgccggacacaagaccctagtccccgagctgatcaaagagctgaacagtctgggcaggccagacatcctggtcatgtgcggcggggtgatccccccccaggactacgagttcctattcgaggtgggagtaagtaacgtgttcggacccgggaccagaatcccaaaggcagccgtccaggtcctggacgacatcgagaaatgcctggaaaagaagcagcagagtgta

SEQ ID NO: 205 - DNA, 2250 bp, Artificial Sequence
  Codon optimized sequence that encodes an MCM polypeptide with the I671V mutation
atgctgcgcgctaagaatcaactcttcctgctgagtcctcactacctgcggcaggtcaaggagtccagcgggtcccggttaattcagcagaggctgctccaccagcagcagcccttacaccccgaatgggccgctcttgcgaagaagcagctcaagggaaagaaccctgaggacctcatttggcataccccagaagggatttccatcaaacctctgtattccaagagagataccatggatcttcccgaagagctaccaggagtgaagcctttcaccaggggcccctacccgaccatgtacacctttcggccttggaccatccgccaatatgctggattctccactgtagaagagtccaacaaattttataaagataatataaaggctgggcaacagggcttatccgtcgctttcgatttggcaactcataggggttacgactcggataatccacgcgtccggggggacgtaggtatggctggggtggctatcgacaccgtggaggataccaagatccttttcgatggaattcccctggagaagatgtccgtaagtatgaccatgaatggggcggtcattcccgtactggctaacttcattgtcactggagaagaacagggagtgcccaaggagaagcttacaggcacaatccaaaatgacatcctgaaggagttcatggttcgcaacacctacatcttcccgccagaaccaagtatgaagataatcgcggacatcttcgagtatactgccaaacacatgcccaaattcaacagtatctcaatttctggctaccacatgcaggaggctggagccgatgctatcttggaactggcatatactctagcagatggactggagtactcccgcaccggcctccaggcaggcctcaccatagacgagttcgcgccgcgcttgtcatttttctggggcatcggtatgaacttttacatggaaatcgccaagatgcgggcaggtcgccggctttgggcacacctgattgagaagatgttccagcctaagaattctaaatcactgctactgagagcccactgtcagacctctggatggtctctaactgaacaagatccctataataacatcgtgcgcacggcgattgaggccatggcagcggtcttcgggggcacacaaagtttgcatacaaacagttttgatgaggcccttggcttacccactgtgaagtcagctagaatcgccaggaatactcagattattatccaagaggaatccggcataccaaaggtggccgacccctgggggggctcctatatgatggagtgcctgactaacgatgtatacgatgcagccctcaaattgattaatgagatcgaagaaatgggagggatggctaaagccgtcgcagagggaatacctaaactgcgcatcgaagaatgcgcagcacggaggcaggcccggatagatagtggtagtgaggtgatcgtgggcgtgaacaagtaccagctggaaaaagaggatgccgtagaagtcctggctattgataatacttcagtccgcaacaggcaaattgagaaactcaagaaaattaagtcatcaagagatcaggccttagctgagcgctgtctcgctgcactgacagaatgcgccgctagtggtgacggcaatatcctggcactcgccgttgatgcgtcacgcgcccgttgcacagtgggcgaaattacagacgccctcaagaaagtgttcggagagcacaaggctaacgatcgaatggtgagcggagcttacaggcaggaatttggtgaaagtaaggaaattacttccgctatcaaacgcgtgcataaattcatggagcgtgaaggtaggagaccaagactcctggtagccaaaatgggacaggatggtcatgaccgcggagcaaaagtgatcgccaccgggttcgcagatttgggcttcgacgttgacatcggtcctcttttccagacaccccgagaggttgcacagcaagcagtggacgctgacgtgcacgcagtgggcgtgtccacactcgcagcaggtcataaaactctggtcccggagctgattaaggagctcaatagtctgggacgccctgacatccttgtcatgtgcgggggcgtcattcccccgcaggactatgaatttctgttcgaggttggggtcagcaacgtcttcgggcccggcaccagaatccctaaagctgcggtgcaagtgttggatgacattgagaagtgcctcgagaagaaacagcagtccgtc

SEQ ID NO: 206 - DNA, 2250 bp, Artificial Sequence
  Codon optimized sequence that encodes an MCM polypeptide with the I671V mutation
atgctgcgagcgaagaatcagctgtttcttctgagtcctcattaccttcggcaggtgaaggaatcctctggatcccgtctgatccagcagcgccttctgcaccagcaacagccacttcaccccgagtgggcggcgctggcaaagaagcagttgaaggggaagaaccctgaagatctgatttggcacaccccggagggtatctctattaagccgctttactccaaacgagacactatggatctgccagaggagctgcccggagtaaagccatttactcggggcccatatcctaccatgtacactttccggccatggaccatacgacagtatgctggtttcagcacagtcgaggaaagtaacaaattttataaggacaatatcaaagcgggccaacaaggactcagtgtagcatttgatctcgctacccacaggggctacgactccgataaccctagagtccggggtgacgtcggaatggcaggcgtcgccatcgacacggtggaggatacgaagattctgtttgacggaatccccctggagaagatgtcagtttctatgacgatgaatggggccgttatccccgtattggctaacttcatcgtgacaggtgaggagcagggggttccgaaggagaagttaaccggtaccatccagaatgatatcctgaaggagtttatggtgaggaacacctacattttcccccctgagccttctatgaagattatcgctgacattttcgagtatactgctaagcacatgcccaagttcaactctatcagcatcagcggttaccacatgcaggaagctggagccgatgctattctcgagctggcatataccctagcggatggtcttgagtatagtagaaccggcttgcaggctggtctgaccatcgacgaatttgctcccagactcagcttcttttggggtatcggcatgaacttctacatggaaatcgctaaaatgagagcagggcggagactctgggcccacctgatcgagaagatgttccagcccaaaaactctaaatcactgctcctcagggcccactgtcagacatccggctggagtttgaccgaacaggatccctacaataacattgttagaactgcaatcgaagctatggccgcagtctttggtggcacccagagtcttcacactaacagtttcgacgaggctttggggttacccaccgtaaaatcagcccgaattgcccggaacacccaaataatcatccaggaagaatccggaattcctaaggtggctgatccttggggcgggagctatatgatggagtgcctgaccaacgatgtgtatgacgctgcgcttaaactgattaatgaaatcgaggagatgggcggtatggccaaagccgttgccgaagggattcccaaacttagaattgaagaatgtgcggcccgcagacaagctcgaattgattccggcagcgaagtgattgtgggcgtgaataagtatcaactcgagaaggaagacgccgtcgaagtattggccatcgacaatacatccgtgcggaatcgtcagatcgaaaaactgaaaaagatcaagtcaagccgcgatcaagctctagctgaaaggtgcttagccgcgctgacggagtgtgccgcttccggggacggtaatatcctcgccctggctgttgacgcttctagggcgagatgcacagtgggcgaaattacagatgcgttgaaaaaggtattcggtgagcataaggctaacgaccggatggtgagtggcgcgtatcggcaagagttcggcgagtctaaagagattacatccgctatcaagcgggtgcacaaattcatggagcgggaggggcgccgaccgaggttgttggtagccaagatgggacaggacggacatgatcggggggctaaggttattgccacagggttcgcagacctcggcttcgacgtggatatcgggcccctgttccagacaccacgcgaggtcgcccaacaggccgtcgacgcagacgtgcacgcagtgggtgtgagtaccctggctgccggacacaaaaccctcgtgcccgaacttatcaaggaattgaacagtcttggcaggccagacatattggttatgtgtggaggggttattccccctcaggactacgagtttttgttcgaagtgggcgtgagcaatgtgtttggccctgggacacgaatccctaaggccgcggtacaggtgctggacgatatcgagaaatgtctggagaagaaacagcagtctgtg

SEQ ID NO: 207 - DNA, 2250 bp, Artificial Sequence
  Codon optimized sequence that encodes an MCM polypeptide with the I671V mutation
atgctgagggcaaaaaatcaactgttcctgcttagcccgcattacctgaggcaggtgaaagagtctagtggatctaggctgattcagcaacgcctcctgcaccaacagcaaccgttacaccccgagtgggccgccctggctaaaaaacagctgaagggtaaaaatcccgaagatcttatttggcatacccctgagggaatatcaatcaagccgctgtattccaaacgggacaccatggatcttcccgaagagctgcccggggtgaaaccattcactcggggaccctacccaactatgtacacgttccggccatggaccatcaggcagtacgccggtttctcaaccgtggaggagtccaataagttttataaggacaatattaaagccggtcagcagggcctgtccgtggctttcgatcttgccacgcatcgaggatacgactcggacaacccccgggtccgcggcgatgtgggcatggctggcgtagctatcgacactgttgaggataccaaaatcttattcgatggaataccacttgagaaaatgagtgtgagtatgacaatgaatggcgccgttattccggttctagccaattttattgtgacaggcgaggaacaaggtgttccgaaggagaagctgactgggacaatccaaaacgatattttaaaagagtttatggtgcgtaatacctacatttttccacccgaaccctcaatgaaaattatagcagatatctttgaatatacggctaagcacatgccaaagttcaactctatcagtatttcaggctaccacatgcaggaggctggggccgacgctattcttgagctcgcctatacactcgctgacgggttggagtatagccgcaccggtctccaggcaggactgaccattgacgaattcgcaccacgactctctttcttctggggcatcggcatgaacttttacatggaaattgccaagatgagagccgggcggcgactttgggcccatctgatcgagaagatgttccagccgaaaaactctaaatctttgctgttgcgcgctcattgccagacttcaggttggtcacttactgagcaggatccttacaacaatatagtgcgtaccgccattgaggctatggccgctgtctttggggggacccagtcgctgcacaccaacagttttgatgaagctctggggctaccaaccgttaagtctgctcggatcgcacgaaatacccagattataatccaggaagaatccgggatcccaaaagtggccgatccctggggcggcagttacatgatggagtgcctcacaaatgatgtatatgacgcagcccttaagcttataaacgaaattgaagaaatgggcggaatggccaaggcagttgcggagggaatacctaagcttcggatcgaagagtgtgctgcacggcgtcaggctcgcatagattccgggtcagaggtgatcgttggagtgaacaaatatcaattggaaaaggaagatgcagtggaggtattggccatcgacaatacctccgttcggaacaggcagatagagaaacttaaaaagattaagagctctcgtgaccaagctctcgcagagaggtgcctggccgctctgactgagtgcgccgccagcggagacgggaatatactcgccttggcagtcgacgcgagccgagcccggtgcacagtgggagaaatcactgatgccctaaagaaagtgttcggcgaacacaaggctaatgaccgaatggtgagcggagcctaccgtcaggagtttggtgaaagcaaggaaatcacctctgctatcaagcgggtgcacaagtttatggagagagaaggcaggagacctcgcttgcttgtggccaagatgggccaggacgggcatgacaggggtgccaaggtgatcgcaacagggttcgccgacttgggcttcgacgtcgatatcgggcccctgtttcagactcctcgagaggttgcacagcaagcggtggatgctgatgttcatgccgttggtgtaagcactctggcggccggacacaaaaccctcgtcccagaattaataaaggagttgaatagcctgggccggcccgatattctcgtaatgtgcggcggagtgataccgccgcaggactatgagtttttgtttgaggtaggcgtcagtaatgtgttcggacctggtacccggattccaaaggcagcggtgcaggtgcttgacgatatcgaaaagtgcctggaaaagaaacagcagtccgtc

SEQ ID NO: 208 - protein, 750 aa, Homo Sapian
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 209 - protein, 750 aa, Artificial Sequence
  MCM I69V
MLRAKNQLFLLSPHYLRQVKESSGSRLIQQRLLHQQQPLHPEWAALAKKQLKGKNPEDLIWHTPEGISVKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 210 - protein, 750 aa, Artificial Sequence [sequence omitted]

SEQ ID NO: 211 - protein, 750 aa, Artificial Sequence [sequence omitted]

SEQ ID NO: 212 - protein, 750 aa, Artificial Sequence
  MCM T598A
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEIASAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 213 - protein, 750 aa, Artificial Sequence [sequence omitted]

SEQ ID NO: 214 - DNA, 2250 bp, Homo sapiens
atgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgta

SEQ ID NO: 215 - DNA, 47 bp, Artificial Sequence
  5UTR-001 Upstream UTR
gggaaataagagagaaaagaagagtaagaagaaatataagagccacc

SEQ ID NO: 216 - DNA, 47 bp, Artificial Sequence
  5UTR-002 Upstream UTR
gggagatcagagagaaaagaagagtaagaagaaatataagagccacc

SEQ ID NO: 217 - DNA, 145 bp, Artificial Sequence
  5UTR-003 Upstream UTR
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 218 - RNA, 42 nt, Artificial Sequence
  5UTR-004 Upstream UTR
gggagacaagcuuggcauuccgguacuguugguaaagccacc

SEQ ID NO: 219 - DNA, 47 bp, Artificial Sequence; identical to SEQ ID NO: 216
  5UTR-005 Upstream UTR

SEQ ID NO: 220 - DNA, 145 bp, Artificial Sequence; identical to SEQ ID NO: 217
  5UTR-006 Upstream UTR

SEQ ID NO: 221 - RNA, 42 nt, Artificial Sequence; identical to SEQ ID NO: 218
  5UTR-007 Upstream UTR

SEQ ID NO: 222 - DNA, 47 bp, Artificial Sequence
  5UTR-008 Upstream UTR
gggaattaacagagaaaagaagagtaagaagaaatataagagccacc

SEQ ID NO: 223 - DNA, 47 bp, Artificial Sequence
  5UTR-009 Upstream UTR
gggaaattagacagaaaagaagagtaagaagaaatataagagccacc

SEQ ID NO: 224 - DNA, 47 bp, Artificial Sequence
  5UTR-010 Upstream UTR
gggaaataagagagtaaagaacagtaagaagaaatataagagccacc

SEQ ID NO: 225 - DNA, 47 bp, Artificial Sequence
  5UTR-011 Upstream UTR
gggaaaaaagagagaaaagaagactaagaagaaatataagagccacc

SEQ ID NO: 226 - DNA, 47 bp, Artificial Sequence
  5UTR-012 Upstream UTR
gggaaataagagagaaaagaagagtaagaagatatataagagccacc

SEQ ID NO: 227 - DNA, 47 bp, Artificial Sequence
  5UTR-013 Upstream UTR
gggaaataagagacaaaacaagagtaagaagaaatataagagccacc

SEQ ID NO: 228 - DNA, 47 bp, Artificial Sequence
  5UTR-014 Upstream UTR
gggaaattagagagtaaagaacagtaagtagaattaaaagagccacc

SEQ ID NO: 229 - DNA, 47 bp, Artificial Sequence
  5UTR-015 Upstream UTR
gggaaataagagagaatagaagagtaagaagaaatataagagccacc

SEQ ID NO: 230 - DNA, 47 bp, Artificial Sequence
  5UTR-016 Upstream UTR
gggaaataagagagaaaagaagagtaagaagaaaattaagagccacc

SEQ ID NO: 231 - DNA, 47 bp, Artificial Sequence
  5UTR-017 Upstream UTR
gggaaataagagagaaaagaagagtaagaagaaatttaagagccacc

SEQ ID NO: 232 - DNA, 371 bp, Artificial Sequence
  3UTR-001 Creatine Kinase
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 233 - DNA, 568 bp, Artificial Sequence
  3UTR-002 Myoglobin
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 234 - DNA, 289 bp, Artificial Sequence
  3UTR-003 alpha-actin
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 235 - DNA, 379 bp, Artificial Sequence
  3UTR-004 Albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 236 - DNA, 118 bp, Artificial Sequence
  3UTR-005 alpha-globin
gctgccttctgcggggcttgccttctggccatgcccttcttctctcccttgcacctgtacctcttggtctttgaataaagcctgagtaggaaggcggccgctcgagcatgcatctaga

SEQ ID NO: 237 - DNA, 908 bp, Artificial Sequence
  3UTR-006 G-CSF
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 238 - DNA, 835 bp, Artificial Sequence
  3UTR-007 Col1a2; collagen, type I, alpha 2
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 239 - DNA, 297 bp, Artificial Sequence
  3UTR-008 Col6a2; collagen, type VI, alpha 2
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 240 - DNA, 602 bp, Artificial Sequence
  3UTR-009 RPN1; ribophorin I
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 241 - DNA, 785 bp, Artificial Sequence
  3UTR-010 LRP1; low density lipoprotein receptor-related protein 1
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 242 - DNA, 3001 bp, Artificial Sequence
  3UTR-011 Nnt1; cardiotrophin-like cytokine factor 1
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 243 - DNA, 1037 bp, Artificial Sequence
  3UTR-012 Col6a1; collagen, type VI, alpha 1
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 244 - DNA, 577 bp, Artificial Sequence
  3UTR-013 Calr; calreticulin
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 245 - DNA, 2212 bp, Artificial Sequence
  3UTR-014 Col1a1; collagen, type I, alpha 1
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 246 - DNA, 729 bp, Artificial Sequence
  3UTR-015 Plod1; procollagen-lysine, 2-oxoglutarate 5-dioxygenase 1
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 247 - DNA, 847 bp, Artificial Sequence
  3UTR-016 Nucb1; nucleobindin 1
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 248 - DNA, 110 bp, Artificial Sequence
  3UTR-017 alpha-globin
gctggagcctcggtggccatgcttcttgccccttgggcctccccccagcccctcctccccttcctgcacccgtacccccgtggtctttgaataaagtctgagtgggcggc

SEQ ID NO: 249 - DNA, 2461 bp, Artificial Sequence
  polynucleotide sequence encoding human MCM
tcaagcttttggaccctcgtacagaagctaatacgactcactatagggaaataagagagaaaagaagagtaagaagaaatataagagccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactccagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtatgataataggctggagcctcggtggccatgcttcttgccccttgggcctccccccagcccctcctccccttcctgcacccgtacccccgtggtctttgaataaagtctgagtgggcggc

SEQ ID NO: 250 - DNA, 2455 bp, Artificial Sequence
  polynucleotide sequence encoding mouse MCM
tcaagcttttggaccctcgtacagaagctaatacgactcactatagggaaataagagagaaaagaagagtaagaagaaatataagagccaccatgttgagagctaagaatcaactttttttgctatcgccccattacctgaagcagctaaacattccatcagcttccagatggaaacgccttctacaccagcagcaaccccttcacccagaatgggctgtactggccaaaaagcagctgaaaggcaaaaacccagaggaccttatatggcacaccccagaagggatctctataaagcccctatattccagggcagatactctggacttacccgaagaacttccaggagtgaagccattcacacggggaccatatcctaccatgtatacctataggccctggaccatccgtcagtatgcaggctttagtactgtggaagaaagcaataaattctataaggacaatattaaggctggtcagcaggggttgtctgttgcctttgacttggcaacacatcgtggttatgattcagacaaccccagagttcgtggagatgttggaatggctggagttgctattgacactgtagaagacaccaaaatcctatttgatggcattcctttagaaaaaatgtccgtttccatgactatgaacggagctgtcatcccagtcctggcaacatttatagtaactggggaagagcaaggtgtgccgaaggagaagctcactggcacaattcagaatgacatcctaaaggagtttatggtcagaaatacttatatttttcccccagagccatcgatgaaaattattgctgacattttccaatacacagcacagcacatgccaaaatttaattccatttcgattagcgggtaccatatgcaggaagcaggagctgatgccattttagaactggcctataccatcgcagatgggttggagtactgcagaactggactccaggctggactcacaattgatgaatttgcaccaaggttgtctttcttctggggaattggaatgaacttctacatggaaatagccaagatgcgagctgggagaagactgtgggctcacttaatagaaaaaatgttccagcctaaaaactctaaatctcttcttctaagagcacactgccagacatcggggtggtcacttactgagcaggatccttacaataacattgtccgcactgcaatcgaagccatggcagctgtgtttggaggaacccagtctttgcatacgaactcttttgatgaagcgctgggtttgcccactgtgaaaagtgcccggattgctcggaacacacagatcatcattcaggaagaatctgggatccccaaagtggcggatccttggggagggtcgtacatgatggagtcgctcacaaatgacgtttatgaggctgctctgaagttgatatatgaagttgaagaaatgggtggaatggccaaagctgtagctgaaggaatccctaaacttcgcattgaagaatgtgctgcccgaagacaagctagaatagattctggttctgaggtaattgttggagtaaataagtatcagttggaaaaagaagactctgtggaggtcctggccattgacaacacttcagtgcgtaagaagcagattgaaaaactcaagaagattaaatccagcagggatcaagctttggctgagcagtgtctcagtgcacttacccagtgtgctgccagtggagatggcaatattctggctctggcagtggatgcagctcgtgcaagatgtacagttggagaaatcacggatgccttgaaaaaagtatttggtgagcataaagctaatgatcgtatggtgagtggagcatatcggcaggagtttggagaaagtaaagagatcacatctgccatcaagagagttaataaattcatggaacgtgaaggtcgcagacctcgtcttcttgtggcaaaaatgggacaagatggccatgacaggggagccaaggtcattgctacaggatttgctgatcttggttttgatgtggacataggccctctttttcagactccccgtgaagtggcgcagcaagctgtggatgcagatgtccatgctgtgggtgtcagcacacttgctgctggtcataaaaccctcgttcctgagcttatcaaagaactcaccgccctggggcggccagatatccttgtcatgtgtgggggcgtgattccaccacaggattatgaatttctgtatgaagttggtgtttccaacgtctttggtcctggaacccggattccaagagctgctgtccaagtgcttgatgatattgagaagtgtttggcagagaagcagcagtctgtgtgataataggctggagcctcggtggccatgcttcttgccccttgggcctccccccagcccctcctccccttcctgcacccgtacccccgtggtctttgaataaagtctgagtgggcggc

SEQ ID NO: 251 - protein, 25 aa, Artificial Sequence
  mitochondrial targeting peptides
MLSLRQSIRFFKPATRTLCSSRYLL

SEQ ID NO: 252 - protein, 16 aa, Artificial Sequence
  mitochondrial targeting peptides
MALLRGVFVVAAKRTP

SEQ ID NO: 253 - protein, 23 aa, Artificial Sequence
  mitochondrial targeting peptides
MLRIPVRKALVGLSKSSKGCVRT

SEQ ID NO: 254 - protein, 31 aa, Artificial Sequence
  mitochondrial targeting peptide
MRQPAVRLVRLGRVPYAELLGLQDRWLRRLQ

SEQ ID NO: 255 - protein, 11 aa, Artificial Sequence
  mitochondrial targeting peptides
METWRKGSFRN

SEQ ID NO: 256 - protein, 28 aa, Artificial Sequence
  mitochondrial targeting peptides
MAALRRMLHLPSLMMGTCRPFAGSLADS

SEQ ID NO: 257 - protein, 33 aa, Artificial Sequence
  mitochondrial targeting peptides
MLLWPLRGWAARALRCFGPGSRGSPASGPGPRR

SEQ ID NO: 258 - protein, 34 aa, Artificial Sequence
  mitochondrial targeting peptides
MRCLTTPMLLRALAQAARAGPPGGRSLHSSAVAA

SEQ ID NO: 259 - protein, 53 aa, Artificial Sequence
  mitochondrial targeting peptides
MAASWRLGCDPRLLRYLVGFPGRRSVGLVKGALGWSVSRGANWRWFHSTQWLR

SEQ ID NO: 260 - protein, 41 aa, Artificial Sequence
  mitochondrial targeting peptides
MSALCWGRGAAGLKRALRPCGRPGLPGKEGTAGGVCGPRRS

SEQ ID NO: 261 - protein, 33 aa, Artificial Sequence
  mitochondrial targeting peptides
MGGLFWRSALRGLRCGPRAPGPSLLVRHGSGGP

SEQ ID NO: 262 - protein, 56 aa, Artificial Sequence
  mitochondrial targeting peptides
MAVLWRLSAVCGALGGRALLLRTPVVRPAHISAFLQDRPIPEWCGVQHIHLSPSHH

SEQ ID NO: 263 - protein, 55 aa, Artificial Sequence
  mitochondrial targeting peptides
MYYKFSGFTQKLAGAWASEAYSPQGLKPVVSTEAPPIIFATPTKLTSDSTVYDYA

SEQ ID NO: 264 - protein, 30 aa, Artificial Sequence
  Mouse methylmalonyl-CoA mutase
MLRAKNQLFLLSPHYLKQLNIPSASRWKRL

SEQ ID NO: 265 - protein, 32 aa, Artificial Sequence
  Human methylmalonyl-CoA mutase
MLRAKNQLFLLSPHYLRQVKESSGSRLIQQRL

SEQ ID NO: 266 - DNA, 92 bp, Artificial Sequence
  5UTR-018 Upstream UTR
tcaagcttttggaccctcgtacagaagctaatacgactcactatagggaaataagagagaaaagaagagtaagaagaaatataagagccacc

SEQ ID NO: 267 - DNA, 119 bp, Artificial Sequence
  3UTR-018
tgataataggctggagcctcggtggccatgcttcttgccccttgggcctccccccagcccctcctccccttcctgcacccgtacccccgtggtctttgaataaagtctgagtgggcggc

SEQ ID NO: 268 - protein, 748 aa, Artificial Sequence
  mouse MCM
MLRAKNQLFLLSPHYLKQLNIPSASRWKRLLHQQQPLHPEWAVLAKKQLKGKNPEDLIWHTPEGISIKPLYSRADTLDLPEELPGVKPFTRGPYPTMYTYRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLATFIVTGEEQGVPKEKLTGTIQNDILKEFMVRNTYIFPPEPSMKIIADIFQYTAQHMPKFNSISISGYHMQEAGADAILELAYTIADGLEYCRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMESLTNDVYEAALKLIYEVEEMGGMAKAVAEGIPKLRIEECAARRQARIDSGSEVIVGVNKYQLEKEDSVEVLAIDNTSVRKKQIEKLKKIKSSRDQALAEQCLSALTQCAASGDGNILALAVDAARARCTVGEITDALKKVFGEHKANDRMVSGAYRQEFGESKEITSAIKRVNKFMEREGRRPRLLVAKMGQDGHDRGAKVIATGFADLGFDVDIGPLFQTPREVAQQAVDADVHAVGVSTLAAGHKTLVPELIKELTALGRPDILVMCGGVIPPQDYEFLYEVGVSNVFGPGTRIPRAAVQVLDDIEKCLAEKQQSV

SEQ ID NO: 269 - protein, 239 aa, Artificial Sequence
  GFP sequence
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 270 - protein, 68 aa, Artificial Sequence
  O14561 mitochondrial targeting peptide
MASRVLSAYVSRLPAAFAPLPRVRMLAVARPLSTALCSAGTQTRLGTLQPALVLAQVPGRVTQLCRQY

SEQ ID NO: 271 - protein, 30 aa, Artificial Sequence
  O14874 mitochondrial targeting peptide
MILASVLRSGPGGGLPLRPLLGPALALRAR

SEQ ID NO: 272 - protein, 45 aa, Artificial Sequence
  O15091mitochondrial targeting peptide
MTFYLFGIRSFPKLWKSPYLGLGPGHSYVSLFLADRCGIRNQQRL

SEQ ID NO: 273 - protein, 29 aa, Artificial Sequence
  O15235 mitochondrial targeting peptide
MSWSGLLHGLNTSLTCGPALVPRLWATCS

SEQ ID NO: 274 - protein, 27 aa, Artificial Sequence
  O15382 mitochondrial targeting peptide
MAAAALGQIWARKLLSVPWLLCGPRRY

SEQ ID NO: 275 - protein, 42 aa, Artificial Sequence
  O43181 mitochondrial targeting peptide
MAAVSMSVVLRQTLWRRRAVAVAALSVSRVPTRSLRTSTWRL

SEQ ID NO: 276 - protein, 31 aa, Artificial Sequence
  O43464 mitochondrial targeting peptide
MAAPRAGRGAGWSLRAWRALGGIRWGRRPRL

SEQ ID NO: 277 - protein, 28 aa, Artificial Sequence
  O43572 mitochondrial targeting peptide
MRGAGPSPRQSPRTLRPDPGPAMSFFRR

SEQ ID NO: 278 - protein, 46 aa, Artificial Sequence
  O43674 mitochondrial targeting peptide
MAAMSLLRRVSVTAVAALSGRPLGTRLGFGGFLTRGFPKAAAPVRH

SEQ ID NO: 279 - protein, 27 aa, Artificial Sequence
  O43677  mitochondrial targeting peptide
MAPSALLRPLSRLLAPARLPSGPSVRS

SEQ ID NO: 280 - protein, 27 aa, Artificial Sequence
  O43766 mitochondrial targeting peptide
MSLRCGDAARTLGPRVFGRYFCSPVRP

SEQ ID NO: 281 - protein, 41 aa, Artificial Sequence
  O43819 mitochondrial targeting peptide
MLLLTRSPTAWHRLSQLKPRVLPGTLGGQALHLRSWLLSRQ

SEQ ID NO: 282 - protein, 34 aa, Artificial Sequence
  O43837 mitochondrial targeting peptide
MAALSGVRWLTRALVSAGNPGAWRGLSTSAAAHA

SEQ ID NO: 283 - protein, 87 aa, Artificial Sequence
  O60313 mitochondrial targeting peptide
MWRLRRAAVACEVCQSLVKHSSGIKGSLPLQKLHLVSRSIYHSHHPTLKLQRPQLRTSFQQFSSLTNLPLRKLKFSPIKYGYQPRRN

SEQ ID NO: 284 - protein, 23 aa, Artificial Sequence
  O60397 mitochondrial targeting peptide
MLWNLLALHQIGQRTISTASHRH

SEQ ID NO: 285 - protein, 22 aa, Artificial Sequence
  O75027 mitochondrial targeting peptide
MALLAMHSWRWAAAAAAFEKRR

SEQ ID NO: 286 - protein, 44 aa, Artificial Sequence
  O75208 mitochondrial targeting peptide
MAAAAVSGALGRAGWRLLQLRCLPVARCRQALVPRAFHASAVGL

SEQ ID NO: 287 - protein, 38 aa, Artificial Sequence
  O75251 mitochondrial targeting peptide
MAVLSAPGLRGFRILGLRSSVGPAVQARGVHQSVATDG

SEQ ID NO: 288 - protein, 33 aa, Artificial Sequence
  O75306 mitochondrial targeting peptide
MAALRALCGFRGVAAQVLRPGAGVRLPIQPSRG

SEQ ID NO: 289 - protein, 28 aa, Artificial Sequence
  O75380 mitochondrial targeting peptide
MAAAMTFCRLLNRCGEAARSLPLGARCF

SEQ ID NO: 290 - protein, 27 aa, Artificial Sequence
  O75390 mitochondrial targeting peptide
MALLTAAARLLGTKNASCLVLAARHAS

SEQ ID NO: 291 - protein, 45 aa, Artificial Sequence
  O75439 mitochondrial targeting peptide
MAAAAARVVLSSAARRRLWGFSESLLIRGAAGRSLYFGENRLRST

SEQ ID NO: 292 - protein, 36 aa, Artificial Sequence
  O75489 mitochondrial targeting peptide
MAAAAVARLWWRGILGASALTRGTGRPSVLLLPVRR

SEQ ID NO: 293 - protein, 38 aa, Artificial Sequence
  O75521 mitochondrial targeting peptide
MAMAYLAWRLARRSCPSSLQVTSFPVVQLHMNRTAMRA

SEQ ID NO: 294 - protein, 21 aa, Artificial Sequence
  O75600 mitochondrial targeting peptide
MWPGNAWRAALFWVPRGRRAQ

SEQ ID NO: 295 - protein, 43 aa, Artificial Sequence
  O75616 mitochondrial targeting peptide
MAAPSWRGARLVQSVLRVWQVGPHVARERVIPFSSLLGFQRRC

SEQ ID NO: 296 - protein, 30 aa, Artificial Sequence
  O75879 mitochondrial targeting peptide
MAAPMLRWGCRGRRWAFARVDGGSCHRRGA

SEQ ID NO: 297 - protein, 56 aa, Artificial Sequence
  O76031 mitochondrial targeting peptide
MPSCGACTCGAAAVRLITSSLASAQRGISGGRIHMSVLGRLGTFETQILQRAPLRS

SEQ ID NO: 298 - protein, 16 aa, Artificial Sequence
  O94925 mitochondrial targeting peptide
MMRLRGSGMLRDLLLR

SEQ ID NO: 299 - protein, 28 aa, Artificial Sequence
  O95169 mitochondrial targeting peptide
MAVARAGVLGVQWLQRASRNVMPLGART

SEQ ID NO: 300 - protein, 33 aa, Artificial Sequence
  O95178 mitochondrial targeting peptide
MSALTRLASFARVGGRLFRSGCARTAGDGGVRH

SEQ ID NO: 301 - protein, 115 aa, Artificial Sequence
  O95202 mitochondrial targeting peptide
MASILLRSCRGRAPARLPPPPRYTVPRGSPGDPAHLSCASTLGLRNCLNVPFGCCTPIHPVYTSSRGDHLGCWALRPECLRIVSRAPWTSTSVGFVAVGPQCLPVRGWHSSRPVR

SEQ ID NO: 302 - protein, 35 aa, Artificial Sequence
  O95299 mitochondrial targeting peptide
MALRLLKLAATSASARVVAAGAQRVRGIHSSVQCK

SEQ ID NO: 303 - protein, 7 aa, Artificial Sequence
  O95571 mitochondrial targeting peptide
MAEAVLR

SEQ ID NO: 304 - protein, 39 aa, Artificial Sequence
  O95822 mitochondrial targeting peptide
MRGFGPGLTARRLLPLRLPPRPPGPRLASGQAAGALERA

SEQ ID NO: 305 - protein, 54 aa, Artificial Sequence
  O95831 mitochondrial targeting peptide
MFRCGGLAAGALKQKLVPLVRTVCVRSPRQRNRLPGNLFQRWHVPLELQMTRQM

SEQ ID NO: 306 - protein, 53 aa, Artificial Sequence
  P00367 mitochondrial targeting peptide
MYRYLGEALLLSRAGPAALGSASADSAALLGWARGQPAAAPQPGLALAARRHY

SEQ ID NO: 307 - protein, 43 aa, Artificial Sequence
  P00390 mitochondrial targeting peptide
MALLPRALSAGAGPSWRRAARAFRGFLLLLPEPAALTRALSRA

SEQ ID NO: 308 - protein, 32 aa, Artificial Sequence
  P00480 mitochondrial targeting peptide
MLFNLRILLNNAAFRNGHNFMVRNFRCGQPLQ

SEQ ID NO: 309 - protein, 29 aa, Artificial Sequence
  P00505 mitochondrial targeting peptide
MALLHSGRVLPGIAAAFHPGLAAAASARA

SEQ ID NO: 310 - protein, 24 aa, Artificial Sequence
  P04179 mitochondrial targeting peptide
MLSRAVCGTSRQLAPALGYLGSRQ

SEQ ID NO: 311 - protein, 35 aa, Artificial Sequence
  P04181 (25) mitochondrial targeting peptide
MFSKLAHLQRFAVLSRGVHSSVASATSVATKKTVQ

SEQ ID NO: 312 - protein, 25 aa, Artificial Sequence
  P04181 (35) mitochondrial targeting peptide
MFSKLAHLQRFAVLSRGVHSSVASA

SEQ ID NO: 313 - protein, 17 aa, Artificial Sequence
  P05091 mitochondrial targeting peptide
MLRAAARFGPRLGRRLL

SEQ ID NO: 314 - protein, 39 aa, Artificial Sequence
  P05108 mitochondrial targeting peptide
MLAKGLPPRSVLVKGCQTFLSAPREGLGRLRVPTGEGAG

SEQ ID NO: 315 - protein, 52 aa, Artificial Sequence
  P05165 mitochondrial targeting peptide
MAGFWVGTAPLVAAGRRGRWPPQQLMLSAALRTLKHVLYYSRQCLMVSRNLG

SEQ ID NO: 316 - protein, 28 aa, Artificial Sequence
  P05166 mitochondrial targeting peptide
MAAALRVAAVGARLSVLASGLRAAVRSL

SEQ ID NO: 317 - protein, 61 aa, Artificial Sequence
  P05496 mitochondrial targeting peptide
MQTAGALFISPALIRCCTRGLIRPVSASFLNSPVNSSKQPSYSNFPLQVARREFQTSVVSR

SEQ ID NO: 318 - protein, 47 aa, Artificial Sequence
  P06576 mitochondrial targeting peptide
MLGFVGRVAAAPASGALRRLTPSASLPPAQLLLRAAPTAVHPVRDYA

SEQ ID NO: 319 - protein, 13 aa, Artificial Sequence
  P07919 mitochondrial targeting peptide
MGLEDEQKMLTES

SEQ ID NO: 320 - protein, 44 aa, Artificial Sequence
  P07954 mitochondrial targeting peptide
MYRALRLLARSRPLVRAPAAALASAPGLGGAAVPSFWPPNAARM

SEQ ID NO: 321 - protein, 30 aa, Artificial Sequence
  P08559 mitochondrial targeting peptide
MRKMLAAVSRVLSGASQKPASRVLVASRNF

SEQ ID NO: 322 - protein, 84 aa, Artificial Sequence
  P08574 mitochondrial targeting peptide
MAAAAASLRGVVLGPRGAGLPGARARGLLCSARPGQLPLRTPQAVALSSKSGLSRGRKVMLSALGMLAAGGAGLAMALHSAVSA

SEQ ID NO: 323 - protein, 35 aa, Artificial Sequence
  P09622 mitochondrial targeting peptide
MQSWSRVYCSLAKRGHFNRISHGLQGLSAVPLRTY

SEQ ID NO: 324 - protein, 22 aa, Artificial Sequence
  P0C7M7 mitochondrial targeting peptide
MKIFFRYQTFRFIWLTKPPGRR

SEQ ID NO: 325 - protein, 14 aa, Artificial Sequence
  P0C7P0 mitochondrial targeting peptide
MRGAGAILRPAARG

SEQ ID NO: 326 - protein, 60 aa, Artificial Sequence
  P10109 mitochondrial targeting peptide
MAAAGGARLLRAASAVLGGPAGRWLHHAGSRAGSSGLLRNRGPGGSAEASRSLSVSARAR

SEQ ID NO: 327 - protein, 25 aa, Artificial Sequence
  P10176 mitochondrial targeting peptide
MSVLTPLLLRGLTGSARRLPVPRAK

SEQ ID NO: 328 - protein, 86 aa, Artificial Sequence
  P10515 mitochondrial targeting peptide
MWRVCARRAQNVAPWAGLEARWTALQEVPGTPRVTSRSGPAPARRNSVTTGYGGVRALCGWTPSSGATPRNRLLLQLLGSPGRRYY

SEQ ID NO: 329 - protein, 31 aa, Artificial Sequence
  P10606 mitochondrial targeting peptide
MASRLLRGAGTLAAQALRARGPSGAAAMRSM

SEQ ID NO: 330 - protein, 26 aa, Artificial Sequence
  P10809 mitochondrial targeting peptide
MLRLPTVFRQMRPVSRVLAPHLTRAY

SEQ ID NO: 331 - protein, 30 aa, Artificial Sequence
  P11177 mitochondrial targeting peptide
MAAVSGLVRRPLREVSGLLKRRFHWTAPAA

SEQ ID NO: 332 - protein, 61 aa, Artificial Sequence
  P11182 mitochondrial targeting peptide
MAAVRMLRTWSRNAGKLICVRYFQTCGNVHVLKPNYVCFFGYPSFKYSHPHHFLKTTAALR

SEQ ID NO: 333 - protein, 25 aa, Artificial Sequence
  P11310 mitochondrial targeting peptide
MAAGFGRCCRVLRSISRFHWRSQHT

SEQ ID NO: 334 - protein, 20 aa, Artificial Sequence
  P11498 mitochondrial targeting peptide
MLKFRTVHGGLRLLGIRRTS

SEQ ID NO: 335 - protein, 24 aa, Artificial Sequence
  P12074 mitochondrial targeting peptide
MAVVGVSSVSRLLGRSRPQLGRPM

SEQ ID NO: 336 - protein, 39 aa, Artificial Sequence
  P12532 mitochondrial targeting peptide
MAGPFSRLLSARPGLRLLALAGAGSLAAGFLLRPEPVRA

SEQ ID NO: 337 - protein, 45 aa, Artificial Sequence
  P12694 mitochondrial targeting peptide
MAVAIAAARVWRLNRGLSQAALLLLRQPGARGLARSHPPRQQQQF

SEQ ID NO: 338 - protein, 22 aa, Artificial Sequence
  P13073 mitochondrial targeting peptide
MLATRVFSLVGKRAISTSVCVR

SEQ ID NO: 339 - protein, 56 aa, Artificial Sequence
  P13196 mitochondrial targeting peptide
MESVVRRCPFLSRVPQAFLQKAGKSLLFYAQNCPKMMEVGAKPAPRALSTAAVHYQ

SEQ ID NO: 340 - protein, 19 aa, Artificial Sequence
  P13804 mitochondrial targeting peptide
MFRAAAPGQLRRAASLLRF

SEQ ID NO: 341 - protein, 35 aa, Artificial Sequence
  P13995 mitochondrial targeting peptide
MAATSLMSALAARLLQPAHSCSLRLRPFHLAAVRN

SEQ ID NO: 342 - protein, 23 aa, Artificial Sequence
  P14406 mitochondrial targeting peptide
MLRNLLALRQIGQRTISTASRRH

SEQ ID NO: 343 - protein, 24 aa, Artificial Sequence
  P15538 mitochondrial targeting peptide
MALRAKAEVCMAVPWLSLQRAQAL

SEQ ID NO: 344 - protein, 16 aa, Artificial Sequence
  P15954 mitochondrial targeting peptide
MLGQSIRRFTTSVVRR

SEQ ID NO: 345 - protein, 24 aa, Artificial Sequence
  P16219 mitochondrial targeting peptide
MAAALLARASGPARRALCPRAWRQ

SEQ ID NO: 346 - protein, 39 aa, Artificial Sequence
  P17540 mitochondrial targeting peptide
MASIFSKLLTGRNASLLFATMGTSVLTTGYLLNRQKVCA

SEQ ID NO: 347 - protein, 32 aa, Artificial Sequence
  P18859 mitochondrial targeting peptide
MILQRLFRFSSVIRSAVSVHLRRNIGVTAVAF

SEQ ID NO: 348 - protein, 24 aa, Artificial Sequence
  P19099 mitochondrial targeting peptide
MALRAKAEVCVAAPWLSLQRARAL

SEQ ID NO: 349 - protein, 32 aa, Artificial Sequence
  P19404 mitochondrial targeting peptide
MFFSAALRARAAGLTAHWGRHVRNLHKTVMQN

SEQ ID NO: 350 - protein, 41 aa, Artificial Sequence
  P20674 mitochondrial targeting peptide
MLGAALRRCAVAATTRADPRGLLHSARTPGPAVAIQSVRCY

SEQ ID NO: 351 - protein, 28 aa, Artificial Sequence
  P21912 mitochondrial targeting peptide
MAAVVALSLRRRLPATTLGGACLQASRG

SEQ ID NO: 352 - protein, 50 aa, Artificial Sequence
  P21953 mitochondrial targeting peptide
MAVVAAAAGWLLRLRAAGAEGHWRRLPGAGLARGFLHPAATVEDAAQRRQ

SEQ ID NO: 353 - protein, 32 aa, Artificial Sequence; identical to SEQ ID NO: 265
  P22033 mitochondrial targeting peptide

SEQ ID NO: 354 - protein, 49 aa, Artificial Sequence
  P22557 mitochondrial targeting peptide
MVTAAMLLQCCPVLARGPTSLLGKVVKTHQFLFGIGRCPILATQGPNCS

SEQ ID NO: 355 - protein, 32 aa, Artificial Sequence
  P22570 mitochondrial targeting peptide
MASRCWRWWGWSAWPRTRLPPAGSTPSFCHHF

SEQ ID NO: 356 - protein, 14 aa, Artificial Sequence
  P22695 mitochondrial targeting peptide
MKLLTRAGSFSRFY

SEQ ID NO: 357 - protein, 54 aa, Artificial Sequence
  P22830 mitochondrial targeting peptide
MRSLGANMAAALRAAGVLLRDPLASSSWRVCQPWRWKSGAAAAAVTTETAQHAQ

SEQ ID NO: 358 - protein, 18 aa, Artificial Sequence
  P23368 mitochondrial targeting peptide
MLSRLRVVSTTCTLACRH

SEQ ID NO: 359 - protein, 35 aa, Artificial Sequence
  P23378 mitochondrial targeting peptide
MQSCARAWGLRLGRGVGGGRRLAGGSGPCWAPRSR

SEQ ID NO: 360 - protein, 48 aa, Artificial Sequence
  P23434 mitochondrial targeting peptide
MALRVVRSVRALLCTLRAVPSPAAPCPPRPWQLGVGAVRTLRTGPALL

SEQ ID NO: 361 - protein, 25 aa, Artificial Sequence
  P23786 mitochondrial targeting peptide
MVPRLLLRAWPRGPAVGPGAPSRPL

SEQ ID NO: 362 - protein, 21 aa, Artificial Sequence
  P24310 mitochondrial targeting peptide
MQALRVSQALIRSFSSTARNR

SEQ ID NO: 363 - protein, 24 aa, Artificial Sequence
  P24311 mitochondrial targeting peptide
MFPLVKSALNRLQVRSIQQTMARQ

SEQ ID NO: 364 - protein, 42 aa, Artificial Sequence
  P24539 mitochondrial targeting peptide
MLSRVVLSAAATAAPSLKNAAFLGPGVLQATRTFHTGQPHLV

SEQ ID NO: 365 - protein, 33 aa, Artificial Sequence
  P24752 mitochondrial targeting peptide
MAVLAALLRSGARSRSPLLRRLVQEIRYVERSY

SEQ ID NO: 366 - protein, 43 aa, Artificial Sequence
  P25705 mitochondrial targeting peptide
MLSVRVAAAVVRALPRRAGLVSRNALGSSFIAARNFHASNTHL

SEQ ID NO: 367 - protein, 29 aa, Artificial Sequence
  P26440 mitochondrial targeting peptide
MATATRLLGWRVASWRLRPPLAGFVSQRA

SEQ ID NO: 368 - protein, 30 aa, Artificial Sequence
  P28330 mitochondrial targeting peptide
MAARLLRGSLRVLGGHRAPRQLPAARCSHS

SEQ ID NO: 369 - protein, 23 aa, Artificial Sequence
  P28331 mitochondrial targeting peptide
MLRIPVRKALVGLSKSPKGCVRT

SEQ ID NO: 370 - protein, 17 aa, Artificial Sequence
  P29372 mitochondrial targeting peptide
MVTPALQMKKPKQFCRR

SEQ ID NO: 371 - protein, 27 aa, Artificial Sequence
  P29803 mitochondrial targeting peptide
MLAAFISRVLRRVAQKSARRVLVASRN

SEQ ID NO: 372 - protein, 24 aa, Artificial Sequence
  P30038 mitochondrial targeting peptide
MLLPAPALRRALLSRPWTGAGLRW

SEQ ID NO: 373 - protein, 41 aa, Artificial Sequence
  P30042 mitochondrial targeting peptide
MAAVRVLVASRLAAASAFTSLSPGGRTPSQRAALHLSVPRP

SEQ ID NO: 374 - protein, 52 aa, Artificial Sequence
  P30044 mitochondrial targeting peptide
MGLAGVCALRRSAGYILVGGAGGQSAAAAARRYSEGEWASGGVRSFSRAAAA

SEQ ID NO: 375 - protein, 62 aa, Artificial Sequence
  P30048 mitochondrial targeting peptide
MAAAVGRLLRASVARHVSAIPWGISATAALRPAACGRTSLTNLLCSGSSQAKLFSTSSSCHA

SEQ ID NO: 376 - protein, 22 aa, Artificial Sequence
  P30049 mitochondrial targeting peptide
MLPAALLRRPGLGRLVRHARAY

SEQ ID NO: 377 - protein, 27 aa, Artificial Sequence
  P30084 mitochondrial targeting peptide
MAALRVLLSCVRGPLRPPVRCPAWRPF

SEQ ID NO: 378 - protein, 29 aa, Artificial Sequence
  P30405 mitochondrial targeting peptide
MLALRCGSRWLGLLSVPRSVPLRLPAARA

SEQ ID NO: 379 - protein, 17 aa, Artificial Sequence
  P30837 mitochondrial targeting peptide
MLRFLAPRLLSLQGRTA

SEQ ID NO: 380 - protein, 43 aa, Artificial Sequence
  P31040 mitochondrial targeting peptide
MSGVRGLSRLLSARRLALAKAWPTVLQTGTRGFHFTVDGNKRA

SEQ ID NO: 381 - protein, 38 aa, Artificial Sequence
  P31327 mitochondrial targeting peptide
MTRILTAFKVVRTLKTGFGFTNVTAHQKWKFSRPGIRL

SEQ ID NO: 382 - protein, 34 aa, Artificial Sequence
  P31930 mitochondrial targeting peptide
MAASVVCRAATAGAQVLLRARRSPALLRTPALRS

SEQ ID NO: 383 - protein, 36 aa, Artificial Sequence
  P31937 mitochondrial targeting peptide
MAASLRLLGAASGLRYWSRRLRPAAGSFAAVCSRSV

SEQ ID NO: 384 - protein, 69 aa, Artificial Sequence
  P33316 mitochondrial targeting peptide
MTPLCPRPALCYHFLTSLLRSAMQNARGARQRAEAAVLSGPGPPLGRAAQHGIPRPLSSAGRLSQGCRG

SEQ ID NO: 385 - protein, 29 aa, Artificial Sequence
  P34897 mitochondrial targeting peptide
MLYFSLFWAARPLQRCGQLVRMAIRAQHS

SEQ ID NO: 386 - protein, 38 aa, Artificial Sequence
  P35218 mitochondrial targeting peptide
MLGRNTWKTSAFSFLVEQMWAPLWSRSMRPGRWCSQRS

SEQ ID NO: 387 - protein, 27 aa, Artificial Sequence
  P35914 mitochondrial targeting peptide
MAAMRKALPRRLVGLASLRAVSTSSMG

SEQ ID NO: 388 - protein, 25 aa, Artificial Sequence
  P36542 mitochondrial targeting peptide
MFSRAGVAGLSAWTLQPQWIQVRNM

SEQ ID NO: 389 - protein, 110 aa, Artificial Sequence
  P36551 mitochondrial targeting peptide
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRA

SEQ ID NO: 390 - protein, 18 aa, Artificial Sequence
  P36639 mitochondrial targeting peptide
MYWSNQITRRLGERVQGF

SEQ ID NO: 391 - protein, 67 aa, Artificial Sequence
  P36776 mitochondrial targeting peptide
MAASTGYVRLWGAARCWVLRRPMLAAAGGRVPTAAGAWLLRGQRTCDASPPWALWGRGPAIGGQWRG

SEQ ID NO: 392 - protein, 67 aa, Artificial Sequence
  P36957 mitochondrial targeting peptide
MLSRSRCVSRAFSRSLSAFQKGNCPLGRRSLPGVSLCQGPGYPNSRKVVINNSVFSVRFFRTTAVCK

SEQ ID NO: 393 - protein, 46 aa, Artificial Sequence
  P38646 mitochondrial targeting peptide
MISASRAAAARLVGAAASRGPTAARHQDSWNGLSHEAFRLVSRRDY

SEQ ID NO: 394 - protein, 33 aa, Artificial Sequence
  P40305 mitochondrial targeting peptide
MEASALTSSAVTSVAKVVRVASGSAVVLPLARI

SEQ ID NO: 395 - protein, 24 aa, Artificial Sequence
  P40926 mitochondrial targeting peptide
MLSALARPASAALRRSFSTSAQNN

SEQ ID NO: 396 - protein, 36 aa, Artificial Sequence
  P40939 mitochondrial targeting peptide
MVACRAIGILSRFSAFRILRSRGYICRNFTGSSALL

SEQ ID NO: 397 - protein, 41 aa, Artificial Sequence
  P42126 mitochondrial targeting peptide
MALVASVRVPARVLLRAGARLPGAALGRTERAAGGGDGARR

SEQ ID NO: 398 - protein, 59 aa, Artificial Sequence
  P42704 mitochondrial targeting peptide
MAALLRSARWLLRAGAAPRLPLSLRLLPGGPGRLHAASYLPAARAGPVAGGLLSPARLY

SEQ ID NO: 399 - protein, 16 aa, Artificial Sequence
  P42765 mitochondrial targeting peptide
MALLRGVFVVAAKRTP

SEQ ID NO: 400 - protein, 42 aa, Artificial Sequence
  P43304 mitochondrial targeting peptide
MAFQKAVKGTILVGGGALATVLGLSQFAHYRRKQMNLAYVKA

SEQ ID NO: 401 - protein, 45 aa, Artificial Sequence
  P43897 mitochondrial targeting peptide
MSLLRSLRVFLVARTGSYPAGSLLRQSPQPRHTFYAGPRLSASAS

SEQ ID NO: 402 - protein, 33 aa, Artificial Sequence
  P45954 mitochondrial targeting peptide
MEGLAVRLLRGSRLLRRNFLTCLSSWKIPPHVS

SEQ ID NO: 403 - protein, 29 aa, Artificial Sequence
  P46199 mitochondrial targeting peptide
MNQKLLKLENLLRFHTIYRQLHSLCQRRA

SEQ ID NO: 404 - protein, 78 aa, Artificial Sequence
  P47985 mitochondrial targeting peptide
MLSVASRSGPFAPVLSATSRGVAGALRPLVQATVPATPEQPVLDLKRPFLSRESLSGQAVRRPLVASVGLNVPASVCY

SEQ ID NO: 405 - protein, 23 aa, Artificial Sequence
  P48047 mitochondrial targeting peptide
MAAPAVSGLSRQVRCFSTSVVRP

SEQ ID NO: 406 - protein, 67 aa, Artificial Sequence
  P48201 mitochondrial targeting peptide
MFACAKLACTPSLIRAGSRVAYRPISASVLSRPEASRTGEGSTVFNGAQNGVSQLIQREFQTSAISR

SEQ ID NO: 407 - protein, 28 aa, Artificial Sequence
  P48728 mitochondrial targeting peptide
MQRAVSVVARLGFRLQAFPPALCRPLSC

SEQ ID NO: 408 - protein, 39 aa, Artificial Sequence
  P48735 mitochondrial targeting peptide
MAGYLRVVRSLCRASGSRPAWAPAALTAPTSQEQPRRHY

SEQ ID NO: 409 - protein, 43 aa, Artificial Sequence
  P49411 mitochondrial targeting peptide
MAAATLLRATPHFSGLAAGRTFLLQGLLRLLKAPALPLLCRGL

SEQ ID NO: 410 - protein, 26 aa, Artificial Sequence
  P49419 mitochondrial targeting peptide
MWRLPRALCVHAAKTSKLSGPWSRPA

SEQ ID NO: 411 - protein, 53 aa, Artificial Sequence
  P49448 mitochondrial targeting peptide
MYRYLAKALLPSRAGPAALGSAANHSAALLGRGRGQPAAASQPGLALAARRHY

SEQ ID NO: 412 - protein, 33 aa, Artificial Sequence
  P49590 mitochondrial targeting peptide
MPLLGLLPRRAWASLLSQLLRPPCASCTGAVRC

SEQ ID NO: 413 - protein, 63 aa, Artificial Sequence
  P49675 mitochondrial targeting peptide
MLLATFKLCAGSSYRHMRNMKGLRQQAVMAISQELNRRALGGPTPSTWINQVRRRSSLLGSRL

SEQ ID NO: 414 - protein, 40 aa, Artificial Sequence
  P49748 mitochondrial targeting peptide
MQAARMAASLGRQLLRLGGGSSRLTALLGQPRPGPARRPY

SEQ ID NO: 415 - protein, 20 aa, Artificial Sequence
  P49821 mitochondrial targeting peptide
MLATRRLLGWSLPARVSVRF

SEQ ID NO: 416 - protein, 42 aa, Artificial Sequence
  P49916 mitochondrial targeting peptide
MSLAFKIFFPQTLRALSRKELCLFRKHHWRDVRQFSQWSETD

SEQ ID NO: 417 - protein, 27 aa, Artificial Sequence
  P50213 mitochondrial targeting peptide
MAGPAWISKVSRLLGAFHNPKQVTRGF

SEQ ID NO: 418 - protein, 37 aa, Artificial Sequence
  P50440 mitochondrial targeting peptide
MLRVRCLRGGSRGAEAVHYIGSRLGRTLTGWVQRTFQ

SEQ ID NO: 419 - protein, 18 aa, Artificial Sequence
  P51398 mitochondrial targeting peptide
MMLKGITRLISRIHKLDP

SEQ ID NO: 420 - protein, 39 aa, Artificial Sequence
  P51553 mitochondrial targeting peptide
MALKVATVAGSAAKAVLGPALLCRPWEVLGAHEVPSRNI

SEQ ID NO: 421 - protein, 47 aa, Artificial Sequence
  P51649 mitochondrial targeting peptide
MATCIWLRSCGARRLGSTFPGCRLRPRAGGLVPASGPAPGPAQLRCY

SEQ ID NO: 422 - protein, 79 aa, Artificial Sequence
  P51687 mitochondrial targeting peptide
MLLLHRAVVLRLQQACRLKSIPSRICIQACSTNDSFQPQRPSLTFSGDNSSTQGWRVMGTLLGLGAVLAYQDHRCRAAQ

SEQ ID NO: 423 - protein, 45 aa, Artificial Sequence
  P52815 mitochondrial targeting peptide
MLPAAARPLWGPCLGLRAAAFRLARRQVPCVCAVRHMRSSGHQRC

SEQ ID NO: 424 - protein, 13 aa, Artificial Sequence
  P53007 mitochondrial targeting peptide
MPAPRAPRALAAA

SEQ ID NO: 425 - protein, 40 aa, Artificial Sequence
  P53597 mitochondrial targeting peptide
MTATLAAAADIATMVSGSSGLAAARLLSRSFLLPQNGIRH

SEQ ID NO: 426 - protein, 37 aa, Artificial Sequence
  P54868 mitochondrial targeting peptide
MQRLLTPVKRILQLTRAVQETSLTPARLLPVAHQRFS

SEQ ID NO: 427 - protein, 33 aa, Artificial Sequence
  P55084 mitochondrial targeting peptide
MTILTYPFKNLPTASKWALRFSIRPLSCSSQLR

SEQ ID NO: 428 - protein, 39 aa, Artificial Sequence
  P55809 mitochondrial targeting peptide
MAALKLLSSGLRLCASARGSGATWYKGCVCSFSTSAHRH

SEQ ID NO: 429 - protein, 34 aa, Artificial Sequence
  P56181 mitochondrial targeting peptide
MAAPCLLRQGRAGALKTMLQEAQVFRGLASTVSL

SEQ ID NO: 430 - protein, 24 aa, Artificial Sequence
  P59942 mitochondrial targeting peptide
MVLPLPWLSRYHFLRLLLPSWSLA

SEQ ID NO: 431 - protein, 22 aa, Artificial Sequence
  P78540 mitochondrial targeting peptide
MSLRGSLSRLLQTRVHSILKKS

SEQ ID NO: 432 - protein, 30 aa, Artificial Sequence
  P78549 mitochondrial targeting peptide
MCSPQESGMTALSARMLTRSRSLGPGAGPR

SEQ ID NO: 433 - protein, 28 aa, Artificial Sequence
  P80404 mitochondrial targeting peptide
MASMLLAQRLACSFQHSYRLLVPGSRHI

SEQ ID NO: 434 - protein, 57 aa, Artificial Sequence
  P82914 mitochondrial targeting peptide
MLRVAWRTLSLIRTRAVTQVLVPGLPGGGSAKFPFNQWGLQPRSLLLQAARGYVVRK

SEQ ID NO: 435 - protein, 115 aa, Artificial Sequence
  P83111 mitochondrial targeting peptide
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLL

SEQ ID NO: 436 - protein, 42 aa, Artificial Sequence
  Q00059 mitochondrial targeting peptide
MAFLRSMWGVLSALGRSGAELCTGCGSRLRSPFSFVYLPRWF

SEQ ID NO: 437 - protein, 49 aa, Artificial Sequence
  Q00325 mitochondrial targeting peptide
MFSSVAHLARANPFNTPHLQLVHDGLGDLRSSSPGPTGQPRRPRNLAAA

SEQ ID NO: 438 - protein, 10 aa, Artificial Sequence
  Q02127 mitochondrial targeting peptide
MAWRHLKKRA

SEQ ID NO: 439 - protein, 40 aa, Artificial Sequence
  Q02218 mitochondrial targeting peptide
MFHLRTCAAKLRPLTASQTVKTFSQNRPAAARTFQQIRCY

SEQ ID NO: 440 - protein, 12 aa, Artificial Sequence
  Q02221 mitochondrial targeting peptide
MALPLRPLTRGL

SEQ ID NO: 441 - protein, 33 aa, Artificial Sequence
  Q02252 mitochondrial targeting peptide
MAALLAAAAVRARILQVSSKVKSSPTWYSASSF

SEQ ID NO: 442 - protein, 33 aa, Artificial Sequence
  Q02318 mitochondrial targeting peptide
MAALGCARLRWALRGAGRGLCPHGARAKAAIPA

SEQ ID NO: 443 - protein, 46 aa, Artificial Sequence
  Q02338 mitochondrial targeting peptide
MLATRLSRPLSRLPGKTLSACDRENGARRPLLLGSTSFIPIGRRTY

SEQ ID NO: 444 - protein, 16 aa, Artificial Sequence
  Q04837 mitochondrial targeting peptide
MFRRPVLQVLRQFVRH

SEQ ID NO: 445 - protein, 42 aa, Artificial Sequence
  Q05932 mitochondrial targeting peptide
MSRARSHLRAALFLAAASARGITTQVAARRGLSAWPVPQEPS

SEQ ID NO: 446 - protein, 66 aa, Artificial Sequence
  Q06055 mitochondrial targeting peptide
MFACSKFVSTPSLVKSTSQLLSRPLSAVVLKRPEILTDESLSSLAVSCPLTSLVSSRSFQTSAISR

SEQ ID NO: 447 - protein, 73 aa, Artificial Sequence
  Q07021 mitochondrial targeting peptide
MLPLLRCVPRVLGSSVAGLRAAAPASPFRQLLQPAPRLCTRPFGLLSVRAGSERRPGLLRPRGPCACGCGCGS

SEQ ID NO: 448 - protein, 35 aa, Artificial Sequence
  Q07973 mitochondrial targeting peptide
MSSPISKSRSLAAFLQQLRSPRQPPRLVTSTAYTS

SEQ ID NO: 449 - protein, 31 aa, Artificial Sequence
  Q08AH1 mitochondrial targeting peptide
MQWLMRFRTLWGIHKSFHNIHPAPSQLRCRS

SEQ ID NO: 450 - protein, 46 aa, Artificial Sequence
  Q08AH3 mitochondrial targeting peptide
MHWLRKVQGLCTLWGTQMSSRTLYINSRQLVSLQWGHQEVPAKFNF

SEQ ID NO: 451 - protein, 33 aa, Artificial Sequence
  Q10713 mitochondrial targeting peptide
MAAVVLAATRLLRGSGSWGCSRLRFGPPAYRRF

SEQ ID NO: 452 - protein, 117 aa, Artificial Sequence
  Q12849 mitochondrial targeting peptide
MAGTRWVLGALLRGCGCNCSSCRRTGAACLPFYSAAGSIPSGVSGRRRLLLLLGAAAAAASQTRGLQTGPVPPGRLAGPPAVATSAAAAAAASYSALRASLLPQSLAAAAAVPTRSY

SEQ ID NO: 453 - protein, 59 aa, Artificial Sequence
  Q12931 mitochondrial targeting peptide
MARELRALLLWGRRLRPLLRAPALAAVPGGKPILCPRRTTAQLGPRRNPAWSLQAGRLF

SEQ ID NO: 454 - protein, 33 aa, Artificial Sequence
  Q13011 mitochondrial targeting peptide
MAAGIVASRRLRDLLTRRLTGSNYPGLSISLRL

SEQ ID NO: 455 - protein, 55 aa, Artificial Sequence
  Q13084 mitochondrial targeting peptide
MPLHKYPVWLWKRLQLREGICSRLPGHYLRSLEEERTPTPVHYRPHGAKFKINPK

SEQ ID NO: 456 - protein, 23 aa, Artificial Sequence
  Q13268 mitochondrial targeting peptide
MLSAVARGYQGWFHPCARLSVRM

SEQ ID NO: 457 - protein, 43 aa, Artificial Sequence
  Q13423 mitochondrial targeting peptide
MANLLKTVVTGCSCPLLSNLGSCKGLRVKKDFLRTFYTHQELW

SEQ ID NO: 458 - protein, 67 aa, Artificial Sequence
  Q13825 mitochondrial targeting peptide
MAAAVAAAPGALGSLHAGGARLVAACSAWLCPGLRLPGSLAGRRAGPAIWAQGWVPAAGGPAPKRGY

SEQ ID NO: 459 - protein, 101 aa, Artificial Sequence
  Q14154 mitochondrial targeting peptide
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQ

SEQ ID NO: 460 - protein, 29 aa, Artificial Sequence
  Q14197 mitochondrial targeting peptide
MAATRCLRWGLSRAGVWLLPPPARCPRRA

SEQ ID NO: 461 - protein, 48 aa, Artificial Sequence
  Q14249 mitochondrial targeting peptide
MRALRAGLTLASGAGLGAVVEGWRRRREDARAAPGLLGRLPVLPVAAA

SEQ ID NO: 462 - protein, 28 aa, Artificial Sequence
  Q15118 mitochondrial targeting peptide
MRLARLLRGAALAGPGPGLRAAGFSRSF

SEQ ID NO: 463 - protein, 48 aa, Artificial Sequence
  Q15390 mitochondrial targeting peptide
MLGWIKRLIRMVFQQVGVSMQSVLWSRKPYGSSRSIVRKIGTNLSLIQ

SEQ ID NO: 464 - protein, 33 aa, Artificial Sequence
  Q16134 mitochondrial targeting peptide
MLVPLAKLSCLAYQCFHALKIKKNYLPLCATRW

SEQ ID NO: 465 - protein, 41 aa, Artificial Sequence
  Q16595 mitochondrial targeting peptide
MWTLGRRAVAGLLASPSPAQAQTLTRVPRPAELAPLCGRRG

SEQ ID NO: 466 - protein, 34 aa, Artificial Sequence
  Q16698 mitochondrial targeting peptide
MKLPARVFFTLGSRLPCGLAPRRFFSYGTKILYQ

SEQ ID NO: 467 - protein, 56 aa, Artificial Sequence
  Q16740 mitochondrial targeting peptide
MWPGILVGGARVASCRYPALGPRLAAHFPAQRPPQRTLQNGLALQRCLHATATRAL

SEQ ID NO: 468 - protein, 13 aa, Artificial Sequence
  Q16775 mitochondrial targeting peptide
MVVGRGLLGRRSL

SEQ ID NO: 469 - protein, 35 aa, Artificial Sequence
  Q16795 mitochondrial targeting peptide
MAAAAQSRVVRVLSMSRSAITAIATSVCHGPPCRQ

SEQ ID NO: 470 - protein, 32 aa, Artificial Sequence
  Q16822 mitochondrial targeting peptide
MAALYRPGLRLNWHGLSPLGWPSCRSIQTLRV

SEQ ID NO: 471 - protein, 12 aa, Artificial Sequence
  Q16836 mitochondrial targeting peptide
MAFVTRQFMRSV

SEQ ID NO: 472 - protein, 39 aa, Artificial Sequence
  Q16854 mitochondrial targeting peptide
MAAGRLFLSRLRAPFSSMAKSPLEGVSSSRGLHAGRGPR

SEQ ID NO: 473 - protein, 33 aa, Artificial Sequence
  Q16891 mitochondrial targeting peptide
MLRACQLSGVTAAAQSCLCGKFVLRPLRPCRRY

SEQ ID NO: 474 - protein, 25 aa, Artificial Sequence
  Q2VYF4 mitochondrial targeting peptide
MAFYSYNSVLAIARTRFPSHFVHPT

SEQ ID NO: 475 - protein, 28 aa, Artificial Sequence
  Q32NB8 mitochondrial targeting peptide
MAVAAAAAAGPVFWRRLLGLLPGRPGLA

SEQ ID NO: 476 - protein, 44 aa, Artificial Sequence
  Q330K2 mitochondrial targeting peptide
MAASAHGSVWGPLRLGIPGLCCRRPPLGLYARMRRLPGPEVSGR

SEQ ID NO: 477 - protein, 19 aa, Artificial Sequence
  Q3SY69 mitochondrial targeting peptide
MLRRGSQALRRFSTGRVYF

SEQ ID NO: 478 - protein, 44 aa, Artificial Sequence
  Q3ZCQ8 mitochondrial targeting peptide
MAASAAVFSRLRSGLRLGSRGLCTRLATPPRRAPDQAAEIGSRG

SEQ ID NO: 479 - protein, 35 aa, Artificial Sequence
  Q49AM1 mitochondrial targeting peptide
MLWKLLLRSQSCRLCSFRKMRSPPKYRPFLACFTY

SEQ ID NO: 480 - protein, 62 aa, Artificial Sequence
  Q4G0N4 mitochondrial targeting peptide
MTCYRGFLLGSCCRVAGGRAAALRGPGAGGPAARPRLGGDGGGRRHLGQGQPRELAGCGSRA

SEQ ID NO: 481 - protein, 83 aa, Artificial Sequence
  Q4G176 mitochondrial targeting peptide
MLPHVVLTFRRLGCALASCRLAPARHRGSGLLHTAPVARSDRSAPVFTRALAFGDRIALVDQHGRHTYRELYSRSLRLSQEIC

SEQ ID NO: 482 - protein, 31 aa, Artificial Sequence
  Q4U2R6 mitochondrial targeting peptide
MAGNLLSGAGRRLWDWVPLACRSFSLGVPRL

SEQ ID NO: 483 - protein, 27 aa, Artificial Sequence
  Q53FZ2 mitochondrial targeting peptide
MLARVTRKMLRHAKCFQRLAIFGSVRA

SEQ ID NO: 484 - protein, 31 aa, Artificial Sequence
  Q53H12 mitochondrial targeting peptide
MTVFFKTLRNHWKKTTAGLCLLTWGGHWLYG

SEQ ID NO: 485 - protein, 98 aa, Artificial Sequence
  Q5EBM0 mitochondrial targeting peptide
MAFARRLLRGPLSGPLLGRRGVCAGAMAPPRRFVLELPDCTLAHFALGADAPGDADAPDPRLAALLGPPERSYSLCVPVTPDAGCGARVRAARLHQRL

SEQ ID NO: 486 - protein, 42 aa, Artificial Sequence
  Q5HYK3 mitochondrial targeting peptide
MAAPGSCALWSYCGRGWSRAMRGCQLLGLRSSWPGDLLSARL

SEQ ID NO: 487 - protein, 41 aa, Artificial Sequence
  Q5JPH6 mitochondrial targeting peptide
MAALLRRLLQRERPSAASGRPVGRREANLGTDAGVAVRVRF

SEQ ID NO: 488 - protein, 15 aa, Artificial Sequence
  Q5JRX3 mitochondrial targeting peptide
MWRCGGRQGLCVLRR

SEQ ID NO: 489 - protein, 23 aa, Artificial Sequence
  Q5JTZ9 mitochondrial targeting peptide
MAASVAAAARRLRRAIRRSPAWR

SEQ ID NO: 490 - protein, 26 aa, Artificial Sequence
  Q5ST30 mitochondrial targeting peptide
MPHLPLASFRPPFWGLRHSRGLPRFH

SEQ ID NO: 491 - protein, 49 aa, Artificial Sequence
  Q5SXM8 mitochondrial targeting peptide
MLRTALRGAPRLLSRVQPRAPCLRRLWGRGARPEVAGRRRAWAWGWRRS

SEQ ID NO: 492 - protein, 16 aa, Artificial Sequence
  Q5T160 mitochondrial targeting peptide
MACGFRRAIACQLSRV

SEQ ID NO: 493 - protein, 36 aa, Artificial Sequence
  Q5T1C6 mitochondrial targeting peptide
MLRSCAARLRTLGALCLPPVGRRLPGSEPRPELRSF

SEQ ID NO: 494 - protein, 9 aa, Artificial Sequence
  Q5T1J5 mitochondrial targeting peptide
MPRGSRSRT

SEQ ID NO: 495 - protein, 39 aa, Artificial Sequence
  Q5T440 mitochondrial targeting peptide
MATAALLRGATPGRGGPVWRWRLRAAPRCRLAHSSCSPG

SEQ ID NO: 496 - protein, 60 aa, Artificial Sequence
  Q5T653 mitochondrial targeting peptide
MALCALTRALRSLNLAPPTVAAPAPSLFPAAQMMNNGLLQQPSALMLLPCRPVLTSVALN

SEQ ID NO: 497 - protein, 57 aa, Artificial Sequence
  Q5TC12 mitochondrial targeting peptide
MAAVVVAAAGGAGPAVLQVAGLYRGLCAVRSRALGLGLVSPAQLRVFPVRPGSGRPE

SEQ ID NO: 498 - protein, 36 aa, Artificial Sequence
  Q5TEU4 mitochondrial targeting peptide
MLRPAGLWRLCRRPWAARVPAENLGRREVTSGVSPR

SEQ ID NO: 499 - protein, 48 aa, Artificial Sequence
  Q5U4N7 mitochondrial targeting peptide
MIQSSQPMSLKLTCSAFRLQRALRFLLGRLPWRVASGARRFRRWLNRY

SEQ ID NO: 500 - protein, 20 aa, Artificial Sequence
  Q5VUM1 mitochondrial targeting peptide
MTPSRLPWLLSWVSATAWRA

SEQ ID NO: 501 - protein, 46 aa, Artificial Sequence; identical to SEQ ID NO: 450
  Q68CK6 mitochondrial targeting peptide

SEQ ID NO: 502 - protein, 70 aa, Artificial Sequence
  Q6DKK2 mitochondrial targeting peptide
MFRLLSWSLGRGFLRAAGRRCRGCSARLLPGLAGGPGPEVQVPPSRVAPHGRGPGLLPLLAALAWFSRPA

SEQ ID NO: 503 - protein, 20 aa, Artificial Sequence
  Q6IN84 mitochondrial targeting peptide
MALLSTVRGATWGRLVTRHF

SEQ ID NO: 504 - protein, 26 aa, Artificial Sequence
  Q6J4K2 mitochondrial targeting peptide
MAGRRLNLRWALSVLCVLLMAETVSG

SEQ ID NO: 505 - protein, 16 aa, Artificial Sequence
  Q6L8Q7 mitochondrial targeting peptide
MWRLPGARAALRVIRT

SEQ ID NO: 506 - protein, 26 aa, Artificial Sequence
  Q6NUN0 mitochondrial targeting peptide
MRPWLRHLVLQALRNSRAFCGSHGKP

SEQ ID NO: 507 - protein, 32 aa, Artificial Sequence
  Q6NVY1 mitochondrial targeting peptide
MGQREMWRLMSRFNAFKRTNTILHHLRMSKHT

SEQ ID NO: 508 - protein, 14 aa, Artificial Sequence
  Q6P161 mitochondrial targeting peptide
MATKRLFGATRTWA

SEQ ID NO: 509 - protein, 30 aa, Artificial Sequence
  Q6P1L8 mitochondrial targeting peptide
MAFFTGLWGPFTCVSRVLSHHCFSTTGSLS

SEQ ID NO: 510 - protein, 21 aa, Artificial Sequence
  Q6P461 mitochondrial targeting peptide
MLGRFQPFSLVRSFRLGFEAC

SEQ ID NO: 511 - protein, 52 aa, Artificial Sequence
  Q6P4F2 mitochondrial targeting peptide
MAASMARGGVSARVLLQAARGTWWNRPGGTSGSGEGVALGTTRKFQATGSRP

SEQ ID NO: 512 - protein, 27 aa, Artificial Sequence
  Q6P587 mitochondrial targeting peptide
MGIMAASRPLSRFWEWGKNIVCVGRNY

SEQ ID NO: 513 - protein, 47 aa, Artificial Sequence
  Q6PI48 mitochondrial targeting peptide
MYFPSWLSQLYRGLSRPIRRTTQPIWGSLYRSLLQSSQRRIPEFSSF

SEQ ID NO: 514 - protein, 27 aa, Artificial Sequence
  Q6SZW1 mitochondrial targeting peptide
MVLTLLLSAYKLCRFFAMSGPRPGAER

SEQ ID NO: 515 - protein, 19 aa, Artificial Sequence
  Q6UB28 mitochondrial targeting peptide
MAAPSGVHLLVRRGSHRIF

SEQ ID NO: 516 - protein, 31 aa, Artificial Sequence
  Q6UB35 mitochondrial targeting peptide
MGTRLPLVLRQLRRPPQPPGPPRRLRVPCRA

SEQ ID NO: 517 - protein, 22 aa, Artificial Sequence
  Q6UWS5 mitochondrial targeting peptide
MSRSSKVVLGLSVLLTAATVAG

SEQ ID NO: 518 - protein, 27 aa, Artificial Sequence
  Q6UXV4 mitochondrial targeting peptide
MAAIRMGKLTTMPAGLIYASVSVHAAK

SEQ ID NO: 519 - protein, 29 aa, Artificial Sequence
  Q6ZSR3 mitochondrial targeting peptide
MGWRFPSPSPRQASPVAPLLAAPTAVRSC

SEQ ID NO: 520 - protein, 39 aa, Artificial Sequence
  Q7L0Y3 mitochondrial targeting peptide
MAAFLKMSVSVNFFRPFTRFLVPFTLHRKRNNLTILQRY

SEQ ID NO: 521 - protein, 29 aa, Artificial Sequence
  Q7L3T8 mitochondrial targeting peptide
MEGLLTRCRALPALATCSRQLSGYVPCRF

SEQ ID NO: 522 - protein, 46 aa, Artificial Sequence
  Q7L592 mitochondrial targeting peptide
MSVLLRSGLGPLCAVARAAIPFIWRGKYFSSGNEPAENPVTPMLRH

SEQ ID NO: 523 - protein, 27 aa, Artificial Sequence
  Q7L8L6 mitochondrial targeting peptide
MAATLKSLKLVRYRAFCSPSAFGAVRS

SEQ ID NO: 524 - protein, 39 aa, Artificial Sequence
  Q7Z2W9 mitochondrial targeting peptide
MAASSLTVTLGRLASACSHSILRPSGPGAASLWSASRRF

SEQ ID NO: 525 - protein, 28 aa, Artificial Sequence
  Q7Z3D6 mitochondrial targeting peptide
MPFTLHLRSRLPSAIRSLILQKKPNIRN

SEQ ID NO: 526 - protein, 29 aa, Artificial Sequence
  Q7Z4L0 mitochondrial targeting peptide
MPLLRGRCPARRHYRRLALLGLQPAPRFA

SEQ ID NO: 527 - protein, 24 aa, Artificial Sequence
  Q7Z5L4 mitochondrial targeting peptide
MIITTWIVYILARKGVGLPFLPIT

SEQ ID NO: 528 - protein, 42 aa, Artificial Sequence
  Q7Z6M4 mitochondrial targeting peptide
MAAFGRQVLDWHRLIPLTWACMARQTPHLGEQRRTTASLLRK

SEQ ID NO: 529 - protein, 33 aa, Artificial Sequence
  Q7Z7F7 mitochondrial targeting peptide
MAAVGSLLGRLRQSTVKATGPALRRLHTSSWRA

SEQ ID NO: 530 - protein, 28 aa, Artificial Sequence
  Q7Z7H8 mitochondrial targeting peptide
MAAAVAGMLRGGLLPQAGRLPTLQTVRY

SEQ ID NO: 531 - protein, 31 aa, Artificial Sequence
  Q86SX6 mitochondrial targeting peptide
MSGSLGRAAAALLRWGRGAGGGGLWGPGVRA

SEQ ID NO: 532 - protein, 23 aa, Artificial Sequence
  Q86TS9 mitochondrial targeting peptide
MAALGTVLFTGVRRLHCSVAAWA

SEQ ID NO: 533 - protein, 8 aa, Artificial Sequence
  Q86U28 mitochondrial targeting peptide
MAAAWGSS

SEQ ID NO: 534 - protein, 55 aa, Artificial Sequence
  Q86U90 mitochondrial targeting peptide
MSPARRCRGMRAAVAASVGLSEGPAGSRSGRLFRPPSPAPAAPGARLLRLPGSGA

SEQ ID NO: 535 - protein, 86 aa, Artificial Sequence
  Q86UT6 mitochondrial targeting peptide
MRWGHHLPRASWGSGFRRALQRPDDRIPFLIHWSWPLQGERPFGPPRAFIRHHGSSVDSAPPPGRHGRLFPSASATEAIQRHRRNL

SEQ ID NO: 536 - protein, 25 aa, Artificial Sequence
  Q86XE5 mitochondrial targeting peptide
MLGPQVWSSVRQGLSRSLSRNVGVW

SEQ ID NO: 537 - protein, 35 aa, Artificial Sequence
  Q86YB7 mitochondrial targeting peptide
MLRVLCLLRPWRPLRARGCASDGAAGGSEIQVRAL

SEQ ID NO: 538 - protein, 65 aa, Artificial Sequence
  Q8IVH4 mitochondrial targeting peptide
MPMLLPHPHQHFLKGLLRAPFRCYHFIFHSSTHLGSGIPCAQPFNSLGLHCTKWMLLSDGLKRKL

SEQ ID NO: 539 - protein, 21 aa, Artificial Sequence
  Q8IVS2 mitochondrial targeting peptide
MSVRVARVAWVRGLGASYRRG

SEQ ID NO: 540 - protein, 29 aa, Artificial Sequence
  Q8IWL3 mitochondrial targeting peptide
MWRGRAGALLRVWGFWPTGVPRRRPLSCD

SEQ ID NO: 541 - protein, 13 aa, Artificial Sequence
  Q8IXM3 mitochondrial targeting peptide
MGVLAAAARCLVR

SEQ ID NO: 542 - protein, 38 aa, Artificial Sequence
  Q8IXQ9 mitochondrial targeting peptide
MALSLGWKAHRNHCGLLLQALRSSGLLLFPCGQCPWRG

SEQ ID NO: 543 - protein, 22 aa, Artificial Sequence
  Q8IYB8 mitochondrial targeting peptide
MSFSRALLWARLPAGRQAGHRA

SEQ ID NO: 544 - protein, 22 aa, Artificial Sequence
  Q8IYU8 mitochondrial targeting peptide
MAAAAGSCARVAAWGGKLRRGL

SEQ ID NO: 545 - protein, 41 aa, Artificial Sequence
  Q8N0V3 mitochondrial targeting peptide
MWAAAGGLWRSRAGLRALFRSRDAALFPGCERGLHCSAVSC

SEQ ID NO: 546 - protein, 22 aa, Artificial Sequence
  Q8N0X4 mitochondrial targeting peptide
MALRLLRRAARGAAAAALLRLK

SEQ ID NO: 547 - protein, 18 aa, Artificial Sequence
  Q8N159 mitochondrial targeting peptide
MATALMAVVLRAAAVAPR

SEQ ID NO: 548 - protein, 36 aa, Artificial Sequence
  Q8N1F1 mitochondrial targeting peptide
MFPGSLSRGRRAAVEMAWLPGSCARVAFAAGAAARY

SEQ ID NO: 549 - protein, 29 aa, Artificial Sequence
  Q8N3J5 mitochondrial targeting peptide
MSTAALITLVRSGGNQVRRRVLLSSRLLQ

SEQ ID NO: 550 - protein, 49 aa, Artificial Sequence
  Q8N442 mitochondrial targeting peptide
MWTLVGRGWGCARALAPRATGAALLVAPGPRSAPTLGAAPESWATDRLY

SEQ ID NO: 551 - protein, 13 aa, Artificial Sequence
  Q8N465 mitochondrial targeting peptide
MLPRRPLAWPAWL

SEQ ID NO: 552 - protein, 49 aa, Artificial Sequence
  Q8N4E7 mitochondrial targeting peptide
MLSCFRLLSRHISPSLASLRPVRCCFALPLRWAPGRPLDPRQIAPRRPL

SEQ ID NO: 553 - protein, 40 aa, Artificial Sequence
  Q8N5M1 mitochondrial targeting peptide
MWRSCLRLRDGGRRLLNRPAGGPSASMSPGPTIPSPARAY

SEQ ID NO: 554 - protein, 29 aa, Artificial Sequence
  Q8N5Z0 mitochondrial targeting peptide
MNYARFITAASAARNPSPIRTMTDILSRG

SEQ ID NO: 555 - protein, 27 aa, Artificial Sequence
  Q8NCN5 mitochondrial targeting peptide
MMFYRLLSIVGRQRASPGWQNWSSARN

SEQ ID NO: 556 - protein, 47 aa, Artificial Sequence
  Q8NCW5 mitochondrial targeting peptide
MSRLRALLGLGLLVAGSRVPRIKSQTIACRSGPTWWGPQRLNSGGRW

SEQ ID NO: 557 - protein, 29 aa, Artificial Sequence
  Q8NE62 mitochondrial targeting peptide
MWCLLRGLGRPGALARGALGQQQSLGARA

SEQ ID NO: 558 - protein, 50 aa, Artificial Sequence
  Q8NE86 mitochondrial targeting peptide
MAAAAGRSLLLLLSSRGGGGGGAGGCGALTAGCFPGLGVSRHRQQQHHRT

SEQ ID NO: 559 - protein, 17 aa, Artificial Sequence
  Q8NFF5 mitochondrial targeting peptide
MGWDLGTRLFQRQEQRS

SEQ ID NO: 560 - protein, 162 aa, Artificial Sequence
  Q8NI60 mitochondrial targeting peptide
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRF

SEQ ID NO: 561 - protein, 32 aa, Artificial Sequence
  Q8TAA5 mitochondrial targeting peptide
MAVRSLWAGRLRVQRLLAWSAAWESKGWPLPF

SEQ ID NO: 562 - protein, 38 aa, Artificial Sequence
  Q8TB37 mitochondrial targeting peptide
MGIWQRLLLFGGVSLRAGGGATAPLGGSRAMVCGRQLS

SEQ ID NO: 563 - protein, 34 aa, Artificial Sequence
  Q8TCC3 mitochondrial targeting peptide
MAGILRLVVQWPPGRLQTVTKGVESLICTDWIRH

SEQ ID NO: 564 - protein, 45 aa, Artificial Sequence
  Q8TCS8 mitochondrial targeting peptide
MAACRYCCSCLRLRPLSDGPFLLPRRDRALTQLQVRALWSSAGSR

SEQ ID NO: 565 - protein, 25 aa, Artificial Sequence
  Q8TF08 mitochondrial targeting peptide
MMFPLARNALSSLKIQSILQSMARH

SEQ ID NO: 566 - protein, 27 aa, Artificial Sequence
  Q8WUK0 mitochondrial targeting peptide
MAATALLEAGLARVLFYPTLLYTLFRG

SEQ ID NO: 567 - protein, 27 aa, Artificial Sequence
  Q8WVM0 mitochondrial targeting peptide
MAASGKLSTCRLPPLPTIREIIKLLRL

SEQ ID NO: 568 - protein, 96 aa, Artificial Sequence
  Q8WWC4 mitochondrial targeting peptide
MALAARLLPQFLHSRSLPCGAVRLRTPAVAEVRLPSATLCYFCRCRLGLGAALFPRSARALAASALPAQGSRWPVLSSPGLPAAFASFPACPQRSY

SEQ ID NO: 569 - protein, 40 aa, Artificial Sequence
  Q8WWV3 mitochondrial targeting peptide
MEFLKTCVLRRNACTAVCFWRSKVVQKPSVRRISTTSPRS

SEQ ID NO: 570 - protein, 16 aa, Artificial Sequence
  Q8WYQ3 mitochondrial targeting peptide
MPRGSRSAASRPASRP

SEQ ID NO: 571 - protein, 65 aa, Artificial Sequence
  Q92665 mitochondrial targeting peptide
MFPRVSTFLPLRPLSRHPLSSGSPETSAAAIMLLTVRHGTVRYRSSALLARTKNNIQRYFGTNSV

SEQ ID NO: 572 - protein, 29 aa, Artificial Sequence
  Q92667 mitochondrial targeting peptide
MAIQFRSLFPLALPGMLALLGWWWFFSRK

SEQ ID NO: 573 - protein, 44 aa, Artificial Sequence
  Q92947 mitochondrial targeting peptide
MALRGVSVRLLSRGPGLHVLRTWVSSAAQTEKGGRTQSQLAKSS

SEQ ID NO: 574 - protein, 50 aa, Artificial Sequence
  Q969P6 mitochondrial targeting peptide
MRVVRLLRLRAALTLLGEVPRRPASRGVPGSRRTQKGSGARWEKEKHEDG

SEQ ID NO: 575 - protein, 81 aa, Artificial Sequence
  Q969Y2 mitochondrial targeting peptide
MWRGLWTLAAQAARGPRRLCTRRSSGAPAPGSGATIFALSSGQGRCGIAVIRTSGPASGHALRILTAPRDLPLARHASLRL

SEQ ID NO: 576 - protein, 107 aa, Artificial Sequence
  Q969Z0 mitochondrial targeting peptide
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRL

SEQ ID NO: 577 - protein, 35 aa, Artificial Sequence
  Q969Z3 mitochondrial targeting peptide
MGASSSSALARLGLPARPWPRWLGVAALGLAAVAL

SEQ ID NO: 578 - protein, 9 aa, Artificial Sequence
  Q96A35 mitochondrial targeting peptide
MRLSALLAL

SEQ ID NO: 579 - protein, 24 aa, Artificial Sequence
  Q96BW9 mitochondrial targeting peptide
MALQTLQSSWVTFRKILSHFPEEL

SEQ ID NO: 580 - protein, 25 aa, Artificial Sequence
  Q96CB9 mitochondrial targeting peptide
MAALTLRGVRELLKRVDLATVPRRH

SEQ ID NO: 581 - protein, 41 aa, Artificial Sequence
  Q96CM8 mitochondrial targeting peptide
MAVYVGMLRLGRLCAGSSGVLGARAALSRSWQEARLQGVRF

SEQ ID NO: 582 - protein, 17 aa, Artificial Sequence
  Q96DC8 mitochondrial targeting peptide
MAAVAVLRAFGASGPMC

SEQ ID NO: 583 - protein, 26 aa, Artificial Sequence
  Q96DV4 mitochondrial targeting peptide
MAAPWWRAALCECRRWRGFSTSAVLG

SEQ ID NO: 584 - protein, 55 aa, Artificial Sequence
  Q96E11 mitochondrial targeting peptide
MALGLKCFRMVHPTFRNYLAASIRPVSEVTLKTVHERQHGHRQYMAYSAVPVRHF

SEQ ID NO: 585 - protein, 68 aa, Artificial Sequence
  Q96E29 mitochondrial targeting peptide
MALSAQQIPRWFNSVKLRSLINAAQLTKRFTRPARTLLHGFSAQPQISSDNCFLQWGFKTYRTSSLWN

SEQ ID NO: 586 - protein, 13 aa, Artificial Sequence
  Q96E52 mitochondrial targeting peptide
MSFICGLQSAARN

SEQ ID NO: 587 - protein, 35 aa, Artificial Sequence
  Q96EL2 mitochondrial targeting peptide
MAASVCSGLLGPRVLSWSRELPCAWRALHTSPVCA

SEQ ID NO: 588 - protein, 37 aa, Artificial Sequence
  Q96EY7 mitochondrial targeting peptide
MAVVSAVRWLGLRSRLGQPLTGRRAGLCEQARSCRFY

SEQ ID NO: 589 - protein, 32 aa, Artificial Sequence
  Q96EY8 mitochondrial targeting peptide
MAVCGLGSRLGLGSRLGLRGCFGAARLLYPRF

SEQ ID NO: 590 - protein, 28 aa, Artificial Sequence
  Q96GC5 mitochondrial targeting peptide
MSGTLEKVLCLRNNTIFKQAFSLLRFRT

SEQ ID NO: 591 - protein, 29 aa, Artificial Sequence
  Q96GW9 mitochondrial targeting peptide
MLRTSVLRLLGRTGASRLSLLEDFGPRYY

SEQ ID NO: 592 - protein, 34 aa, Artificial Sequence
  Q96H96 mitochondrial targeting peptide
MLGSRAAGFARGLRALALAWLPGWRGRSFALARA

SEQ ID NO: 593 - protein, 35 aa, Artificial Sequence
  Q96I23 mitochondrial targeting peptide
MLSGARCRLASALRGTRAPPSAVARRCLHASGSRP

SEQ ID NO: 594 - protein, 14 aa, Artificial Sequence
  Q96I59 mitochondrial targeting peptide
MLGVRCLLRSVRFC

SEQ ID NO: 595 - protein, 37 aa, Artificial Sequence
  Q96I99 mitochondrial targeting peptide
MASPVAAQAGKLLRALALRPRFLAAGSQAVQLTSRRW

SEQ ID NO: 596 - protein, 39 aa, Artificial Sequence
  Q96IL0 mitochondrial targeting peptide
MLPCAAGARGRGAMVVLRAGKKTFLPPLCRAFACRGCQL

SEQ ID NO: 597 - protein, 15 aa, Artificial Sequence
  Q96MF6 mitochondrial targeting peptide
MAWAGSRRVPAGTRA

SEQ ID NO: 598 - protein, 36 aa, Artificial Sequence
  Q96PE7 mitochondrial targeting peptide
MARVLKAAAANAVGLFSRLQAPIPTVRASSTSQPLD

SEQ ID NO: 599 - protein, 41 aa, Artificial Sequence
  Q96Q11 mitochondrial targeting peptide
MLRCLYHWHRPVLNRRWSRLCLPKQYLFTMKLQSPEFQSLF

SEQ ID NO: 600 - protein, 35 aa, Artificial Sequence
  Q96QE5 mitochondrial targeting peptide
MSGSVLFTAGERWRCFLTPSRSSLYWALHNFCCRK

SEQ ID NO: 601 - protein, 36 aa, Artificial Sequence
  Q96RP9 mitochondrial targeting peptide
MRLLGAAAVAALGRGRAPASLGWQRKQVNWKACRWS

SEQ ID NO: 602 - protein, 41 aa, Artificial Sequence
  Q96RQ3 mitochondrial targeting peptide
MAAASAVSVLLVAAERNRWHRLPSLLLPPRTWVWRQRTMKY

SEQ ID NO: 603 - protein, 31 aa, Artificial Sequence
  Q96RR1 mitochondrial targeting peptide
MWVLLRSGYPLRILLPLRGEWMGRRGLPRNL

SEQ ID NO: 604 - protein, 57 aa, Artificial Sequence
  Q99551 mitochondrial targeting peptide
MQSLSLGQTSISKGLNYLTIMAPGNLWHMRNNFLFGSRCWMTRFSAENIFKSVSFRL

SEQ ID NO: 605 - protein, 29 aa, Artificial Sequence
  Q99643 mitochondrial targeting peptide
MAALLLRHVGRHCLRAHFSPQLCIRNAVP

SEQ ID NO: 606 - protein, 59 aa, Artificial Sequence
  Q99757 mitochondrial targeting peptide
MAQRLLLRRFLASVISRKPSQGQWPPLTSRALQTPQCSPGGLTVTPNPARTIYTTRISL

SEQ ID NO: 607 - protein, 40 aa, Artificial Sequence
  Q99766 mitochondrial targeting peptide
MCCAVSEQRLTCADQMMPFGKISQQLCGVKKLPWSCDSRY

SEQ ID NO: 608 - protein, 35 aa, Artificial Sequence
  Q99797 mitochondrial targeting peptide
MLCVGRLGGLGARAAALPPRRAGRGSLEAGIRARR

SEQ ID NO: 609 - protein, 27 aa, Artificial Sequence
  Q99798 mitochondrial targeting peptide
MAPYSLLVTRLQKALGVRQYHVASVLC

SEQ ID NO: 610 - protein, 35 aa, Artificial Sequence
  Q99807 mitochondrial targeting peptide
MSCAGAAAAPRLWRLRPGARRSLSAYGRRTSVRFR

SEQ ID NO: 611 - protein, 16 aa, Artificial Sequence
  Q9BQ52 mitochondrial targeting peptide
MWALCSLLRSAAGRTM

SEQ ID NO: 612 - protein, 48 aa, Artificial Sequence
  Q9BQ95 mitochondrial targeting peptide
MSWVQATLLARGLCRAWGGTCGAALTGTSISQVPRRLPRGLHCSAAAH

SEQ ID NO: 613 - protein, 13 aa, Artificial Sequence
  Q9BRT2 mitochondrial targeting peptide
MAASRYRRFLKLC

SEQ ID NO: 614 - protein, 35 aa, Artificial Sequence
  Q9BSE5 mitochondrial targeting peptide
MLRLLASGCARGPGPGVGARPAAGLFHPGRRQSRQ

SEQ ID NO: 615 - protein, 20 aa, Artificial Sequence
  Q9BT30 mitochondrial targeting peptide
MAGTGLLALRTLPGPSWVRG

SEQ ID NO: 616 - protein, 81 aa, Artificial Sequence
  Q9BUB7 mitochondrial targeting peptide
MLFLALGSPWAVELPLCGRRTALCAAAALRGPRASVSRASSSSGPSGPVAGWSTGPSGAARLLRRPGRAQIPVYWEGYVRF

SEQ ID NO: 617 - protein, 12 aa, Artificial Sequence
  Q9BUE6 mitochondrial targeting peptide
MSASLVRATVRA

SEQ ID NO: 618 - protein, 53 aa, Artificial Sequence
  Q9BV79 mitochondrial targeting peptide
MWVCSTLWRVRTPARQWRGLLPASGCHGPAASSYSASAEPARVRALVYGHHGD

SEQ ID NO: 619 - protein, 18 aa, Artificial Sequence
  Q9BVV7 mitochondrial targeting peptide
MICTFLRAVQYTEKLHRS

SEQ ID NO: 620 - protein, 46 aa, Artificial Sequence
  Q9BW91 mitochondrial targeting peptide
MAGRLLGKALAAVSLSLALASVTIRSSRCRGIQAFRNSFSSSWFHL

SEQ ID NO: 621 - protein, 17 aa, Artificial Sequence
  Q9BX68 mitochondrial targeting peptide
MAAAVVLAAGLRAARRA

SEQ ID NO: 622 - protein, 77 aa, Artificial Sequence
  Q9BXM7 mitochondrial targeting peptide
MAVRQALGRGLQLGRALLLRFTGKPGRAYGLGRPGPAAGCVRGERPGWAAGPGAEPRRVGLGLPNRLRFFRQSVAGL

SEQ ID NO: 623 - protein, 39 aa, Artificial Sequence
  Q9BYC2 mitochondrial targeting peptide
MAALRLLASVLGRGVPAGGSGLALSQGCARCFATSPRLR

SEQ ID NO: 624 - protein, 45 aa, Artificial Sequence
  Q9BYC9 mitochondrial targeting peptide
MVFLTAQLWLRNRVTDRYFRIQEVLKHARHFRGRKNRCYRLAVRT

SEQ ID NO: 625 - protein, 50 aa, Artificial Sequence
  Q9BYD6 mitochondrial targeting peptide
MAAAVRCMGRALIHHQRHSLSKMVYQTSLCSCSVNIRVPNRHFAAATKSA

SEQ ID NO: 626 - protein, 27 aa, Artificial Sequence
  Q9BYN8 mitochondrial targeting peptide
MLRALSRLGAGTPCRPRAPLVLPARGR

SEQ ID NO: 627 - protein, 37 aa, Artificial Sequence
  Q9BYT8 mitochondrial targeting peptide
MIARCLLAVRSLRRVGGSRILLRMTLGREVMSPLQAM

SEQ ID NO: 628 - protein, 41 aa, Artificial Sequence
  Q9BYV1 mitochondrial targeting peptide
MTLIWRHLLRPLCLVTSAPRILEMHPFLSLGTSRTSVTKLS

SEQ ID NO: 629 - protein, 46 aa, Artificial Sequence
  Q9BZ23 mitochondrial targeting peptide
MRRLGPFHPRVHWAAPPSLSSGLHRLLFLRGTRIPSSTTLSPPRHD

SEQ ID NO: 630 - protein, 29 aa, Artificial Sequence
  Q9BZE1 mitochondrial targeting peptide
MALASGPARRALAGSGQLGLGGFGAPRRG

SEQ ID NO: 631 - protein, 42 aa, Artificial Sequence
  Q9GZT6 mitochondrial targeting peptide
MNSRQAWRLFLSQGRGDRWVSRPRGHFSPALRREFFTTTTKE

SEQ ID NO: 632 - protein, 36 aa, Artificial Sequence
  Q9H078 mitochondrial targeting peptide
MLGSLVLRRKALAPRLLLRLLRSPTLRGHGGASGRN

SEQ ID NO: 633 - protein, 34 aa, Artificial Sequence
  Q9H1K1 mitochondrial targeting peptide
MAAAGAFRLRRAASALLLRSPRLPARELSAPARL

SEQ ID NO: 634 - protein, 31 aa, Artificial Sequence
  Q9H2K0 mitochondrial targeting peptide
MAALFLKRLTLQTVKSENSCIRCFGKHILQK

SEQ ID NO: 635 - protein, 32 aa, Artificial Sequence
  Q9H2U2 mitochondrial targeting peptide
MSALLRLLRTGAPAAACLRLGTSAGTGSRRAM

SEQ ID NO: 636 - protein, 52 aa, Artificial Sequence
  Q9H300 mitochondrial targeting peptide
MAWRGWAQRGWGCGQAWGASVGGRSCEELTAVLTPPQLLGRRFNFFIQQKCG

SEQ ID NO: 637 - protein, 47 aa, Artificial Sequence
  Q9H3H1 mitochondrial targeting peptide
MASVAAARAVPVGSGLRGLQRTLPLVVILGATGTGKSTLALQLGQRL

SEQ ID NO: 638 - protein, 35 aa, Artificial Sequence
  Q9H3J6 mitochondrial targeting peptide
MSTVGLFHFPTPLTRICPAPWGLRLWEKLTLLSPG

SEQ ID NO: 639 - protein, 44 aa, Artificial Sequence
  Q9H3K2 mitochondrial targeting peptide
MLAARLVCLRTLPSRVFHPAFTKASPVVKNSITKNQWLLTPSRE

SEQ ID NO: 640 - protein, 38 aa, Artificial Sequence
  Q9H3L0 mitochondrial targeting peptide
MANVLCNRARLVSYLPGFCSLVKRVVNPKAFSTAGSSG

SEQ ID NO: 641 - protein, 29 aa, Artificial Sequence
  Q9H4B0 mitochondrial targeting peptide
MLILTKTAGVFFKPSKRKVYEFLRSFNFH

SEQ ID NO: 642 - protein, 47 aa, Artificial Sequence
  Q9H4I9 mitochondrial targeting peptide
MASGAARWLVLAPVRSGALRSGPSLRKDGDVSAAWSGSGRSLVPSRS

SEQ ID NO: 643 - protein, 19 aa, Artificial Sequence
  Q9H5Q4 mitochondrial targeting peptide
MWIPVVGLPRRLRLSALAG

SEQ ID NO: 644 - protein, 29 aa, Artificial Sequence
  Q9H6R3 mitochondrial targeting peptide
MKPSWLQCRKVTSAGGLGGPLPGSSPARG

SEQ ID NO: 645 - protein, 19 aa, Artificial Sequence
  Q9H7H0 mitochondrial targeting peptide
MAAALKCLLTLGRWCPGLG

SEQ ID NO: 646 - protein, 37 aa, Artificial Sequence
  Q9H8M1 mitochondrial targeting peptide
MAARTGHTALRRVVSGCRPKSATAAGAQAPVRNGRYL

SEQ ID NO: 647 - protein, 30 aa, Artificial Sequence
  Q9H9J2 mitochondrial targeting peptide
MASGLVRLLQQGHRCLLAPVAPKLVPPVRG

SEQ ID NO: 648 - protein, 51 aa, Artificial Sequence
  Q9H9P8 mitochondrial targeting peptide
MVPALRYLVGACGRARGLFAGGSPGACGFASGRPRPLCGGSRSASTSSFDI

SEQ ID NO: 649 - protein, 17 aa, Artificial Sequence
  Q9HA92 mitochondrial targeting peptide
MALPGARARGWAAAARA

SEQ ID NO: 650 - protein, 38 aa, Artificial Sequence
  Q9HAC7 mitochondrial targeting peptide
MPSETHAMLATLARVAALRRTCLFSGRGGGRGLWTGRP

SEQ ID NO: 651 - protein, 27 aa, Artificial Sequence
  Q9HAV7 mitochondrial targeting peptide
MAAQCVRLARRSLPALALSLRPSPRLL

SEQ ID NO: 652 - protein, 47 aa, Artificial Sequence
  Q9HB07 mitochondrial targeting peptide
MGHQFLRGLLTLLLPPPPLYTRHRMLGPESVPPPKRSRSKLMAPPRI

SEQ ID NO: 653 - protein, 39 aa, Artificial Sequence
  Q9HBH1 mitochondrial targeting peptide
MARLWGALSLWPLWAAVPWGGAAAVGVRACSSTAAPDGV

SEQ ID NO: 654 - protein, 40 aa, Artificial Sequence
  Q9HC36 mitochondrial targeting peptide
MAALVRPARFVVRPLLQVVQAWDLDARRWVRALRRSPVKV

SEQ ID NO: 655 - protein, 22 aa, Artificial Sequence
  Q9HCC0 mitochondrial targeting peptide
MWAVLRLALRPCARASPAGPRA

SEQ ID NO: 656 - protein, 49 aa, Artificial Sequence
  Q9HD23 mitochondrial targeting peptide
MECLRSLPCLLPRAMRLPRRTLCALALDVTSVGPPVAACGRRANLIGRS

SEQ ID NO: 657 - protein, 36 aa, Artificial Sequence
  Q9NNW7 mitochondrial targeting peptide
MAAMAVALRGLGGRFRWRTQAVAGGVRGAARGAAAG

SEQ ID NO: 658 - protein, 34 aa, Artificial Sequence
  Q9NP81 mitochondrial targeting peptide
MAASMARRLWPLLTRRGFRPRGGCISNDSPRRSF

SEQ ID NO: 659 - protein, 31 aa, Artificial Sequence
  Q9NPB1 mitochondrial targeting peptide
MIRLGGWCARRLCSAAVPAGRRGAAGGLGLA

SEQ ID NO: 660 - protein, 32 aa, Artificial Sequence
  Q9NPH0 mitochondrial targeting peptide
MITGVFSMRLWTPVGVLTSLAYCLHQRRVALA

SEQ ID NO: 661 - protein, 46 aa, Artificial Sequence
  Q9NQ50 mitochondrial targeting peptide
MTASVLRSISLALRPTSGLLGTWQTQLRETHQRASLLSFWELIPMR

SEQ ID NO: 662 - protein, 58 aa, Artificial Sequence
  Q9NQZ5 mitochondrial targeting peptide
MLPRRLLAAWLAGTRGGGLLALLANQCRFVTGLRVRRAQQIAQLYGRLYSESSRRVLL

SEQ ID NO: 663 - protein, 55 aa, Artificial Sequence
  Q9NR28 mitochondrial targeting peptide
MAALKSWLSRSVTSFFRYRQCLCVPVVANFKKRCFSELIRPWHKTVTIGFGVTLC

SEQ ID NO: 664 - protein, 105 aa, Artificial Sequence
  Q9NRK6 mitochondrial targeting peptide
MRGPPAWPLRLLEPPSPAEPGRLLPVACVWAAASRVPGSLSPFTGLRPARLWGAGPALLWGVGAARRWRSGCRGGGPGASRGVLGLARLLGLWARGPGSCRCGAF

SEQ ID NO: 665 - protein, 30 aa, Artificial Sequence
  Q9NRP4 mitochondrial targeting peptide
MPGRHVSRVRALYKRVLQLHRVLPPDLKSL

SEQ ID NO: 666 - protein, 8 aa, Artificial Sequence
  Q9NRX2 mitochondrial targeting peptide
MRLSVAAA

SEQ ID NO: 667 - protein, 19 aa, Artificial Sequence
  Q9NS18 mitochondrial targeting peptide
MIWRRAALAGTRLVWSRSG

SEQ ID NO: 668 - protein, 48 aa, Artificial Sequence
  Q9NSE4 mitochondrial targeting peptide
MRWGLRPRGPGAAALATARSLWGTPRLPCSPGWQGATKRLLVRSVSGA

SEQ ID NO: 669 - protein, 37 aa, Artificial Sequence
  Q9NUB1 mitochondrial targeting peptide
MAARTLGRGVGRLLGSLRGLSGQPARPPCGVSAPRRA

SEQ ID NO: 670 - protein, 52 aa, Artificial Sequence
  Q9NUJ1 mitochondrial targeting peptide
MAVARLAAVAAWVPCRSWGWAAVPFGPHRGLSVLLARIPQRAPRWLPACRQK

SEQ ID NO: 671 - protein, 55 aa, Artificial Sequence
  Q9NUT2 mitochondrial targeting peptide
MLVHLFRVGIRGGPFPGRLLPPLRFQTFSAVRNTWRNGKTGQLHKAEGEYSDGYR

SEQ ID NO: 672 - protein, 15 aa, Artificial Sequence
  Q9NVH6 mitochondrial targeting peptide
MWYHRLSHLHSRLQD

SEQ ID NO: 673 - protein, 34 aa, Artificial Sequence
  Q9NVS2 mitochondrial targeting peptide
MAALKALVSGCGRLLRGLLAGPAATSWSRLPARG

SEQ ID NO: 674 - protein, 37 aa, Artificial Sequence
  Q9NVV4 mitochondrial targeting peptide
MAVPGVGLLTRLNLCARRRTRVQRPIVRLLSCPGTVA

SEQ ID NO: 675 - protein, 35 aa, Artificial Sequence
  Q9NWR8 mitochondrial targeting peptide
MLQRGLWPWRTRLLPTPGTWRPARPWPLPPPPQVL

SEQ ID NO: 676 - protein, 12 aa, Artificial Sequence
  Q9NWS8 mitochondrial targeting peptide
MPATLLRAVARS

SEQ ID NO: 677 - protein, 27 aa, Artificial Sequence
  Q9NWU1 mitochondrial targeting peptide
MSNCLQNFLKITSTRLLCSRLCQQLRS

SEQ ID NO: 678 - protein, 40 aa, Artificial Sequence
  Q9NWU5 mitochondrial targeting peptide
MAAAVLGQLGALWIHNLRSRGKLALGVLPQSYIHTSASLD

SEQ ID NO: 679 - protein, 29 aa, Artificial Sequence
  Q9NX14 mitochondrial targeting peptide
MAAGLFGLSARRLLAAAATRGLPAARVRW

SEQ ID NO: 680 - protein, 29 aa, Artificial Sequence
  Q9NX18 mitochondrial targeting peptide
MAVSTVFSTSSLMLALSRHSLLSPLLSVT

SEQ ID NO: 681 - protein, 36 aa, Artificial Sequence
  Q9NX20 mitochondrial targeting peptide
MWRLLARASAPLLRVPLSDSWALLPASAGVKTLLPV

SEQ ID NO: 682 - protein, 27 aa, Artificial Sequence
  Q9NX46 mitochondrial targeting peptide
MAAAAMAAAAGGGAGAARSLSRFRGCL

SEQ ID NO: 683 - protein, 36 aa, Artificial Sequence
  Q9NXA8 mitochondrial targeting peptide
MRPLQIVPSRLISQLYCGLKPPASTRNQICLKMARP

SEQ ID NO: 684 - protein, 85 aa, Artificial Sequence
  Q9NZJ6 mitochondrial targeting peptide
MWSGRKLGSSGGWFLRVLGPGGCNTKAARPLISSAVYVKNQLSGTLQIKPGVFNEYRTIWFKSYRTIFSCLNRIKSFRYPWARLY

SEQ ID NO: 685 - protein, 21 aa, Artificial Sequence
  Q9P015 mitochondrial targeting peptide
MAGPLQGGGARALDLLRGLPR

SEQ ID NO: 686 - protein, 71 aa, Artificial Sequence
  Q9P0J1 mitochondrial targeting peptide
MPAPTQLFFPLIRNCELSRIYGTACYCHHKHLCCSSSYIPQSRLRYTPHPAYATFCRPKENWWQYTQGRRY

SEQ ID NO: 687 - protein, 66 aa, Artificial Sequence
  Q9P2J9 mitochondrial targeting peptide
MSSTVSYWILNSTRNSIATLQGGRRLYSRYVSNRNKLKWRLFSRVPPTLNSSPCGGFTLCKAYRHT

SEQ ID NO: 688 - protein, 52 aa, Artificial Sequence
  Q9P2R7 mitochondrial targeting peptide
MAASMFYGRLVAVATLRNHRPRTAQRAAAQVLGSSGLFNNHGLQVQQQQQRN

SEQ ID NO: 689 - protein, 32 aa, Artificial Sequence
  Q9UDR5 mitochondrial targeting peptide
MLQVHRTGLGRLGVSLSKGLHHKAVLAVRRED

SEQ ID NO: 690 - protein, 26 aa, Artificial Sequence
  Q9UGC7 mitochondrial targeting peptide
MRSRVLWGAARWLWPRRAVGPARRPL

SEQ ID NO: 691 - protein, 18 aa, Artificial Sequence
  Q9UGM6 mitochondrial targeting peptide
MALHSMRKARERWSFIRA

SEQ ID NO: 692 - protein, 50 aa, Artificial Sequence
  Q9UI17 mitochondrial targeting peptide
MLRPGAQLLRGLLLRSCPLQGSPGRPRSVCGREGEEKPPLSAETQWKDRA

SEQ ID NO: 693 - protein, 14 aa, Artificial Sequence
  Q9UI32 mitochondrial targeting peptide
MRSMKALQKALSRA

SEQ ID NO: 694 - protein, 18 aa, Artificial Sequence
  Q9UI43 mitochondrial targeting peptide
MAGYLKLVCVSFQRQGFH

SEQ ID NO: 695 - protein, 25 aa, Artificial Sequence
  Q9UII2 mitochondrial targeting peptide
MAVTALAARTWLGVWGVRTMQARGF

SEQ ID NO: 696 - protein, 23 aa, Artificial Sequence
  Q9UJ68 mitochondrial targeting peptide
MLSATRRACQLLLLHSLFPVPRM

SEQ ID NO: 697 - protein, 28 aa, Artificial Sequence
  Q9UJZ1 mitochondrial targeting peptide
MLARAARGTGALLLRGSLLASGRAPRRA

SEQ ID NO: 698 - protein, 22 aa, Artificial Sequence
  Q9UKU7 mitochondrial targeting peptide
MLWSGCRRFGARLGCLPGGLRV

SEQ ID NO: 699 - protein, 22 aa, Artificial Sequence
  Q9UL12 mitochondrial targeting peptide
MASLSRALRVAAAHPRQSPTRG

SEQ ID NO: 700 - protein, 73 aa, Artificial Sequence
  Q9ULD0 mitochondrial targeting peptide
MSQLRLLPSRLGVQAARLLAAHDVPVFGWRSRSSGPPATFPSSKGGGGSSYMEEMYFAWLENPQSVHKSWDSF

SEQ ID NO: 701 - protein, 9 aa, Artificial Sequence
  Q9UMS0 mitochondrial targeting peptide
MAATARRGW

SEQ ID NO: 702 - protein, 25 aa, Artificial Sequence
  Q9Y234 mitochondrial targeting peptide
MLIPFSMKNCFQLLCNCQVPAAGFK

SEQ ID NO: 703 - protein, 41 aa, Artificial Sequence
  Q9Y2C4 mitochondrial targeting peptide
MAIKSIASRLRGSRRFLSGFVAGAVVGAAGAGLAALQFFRS

SEQ ID NO: 704 - protein, 33 aa, Artificial Sequence
  Q9Y2D0 mitochondrial targeting peptide
MVVMNSLRVILQASPGKLLWRKFQIPRFMPARP

SEQ ID NO: 705 - protein, 71 aa, Artificial Sequence
  Q9Y2Q9 mitochondrial targeting peptide
MAALCRTRAVAAESHFLRVFLFFRPFRGVGTESGSESGSSNAKEPKTRAGGFASALERHSELLQKVEPLQK

SEQ ID NO: 706 - protein, 20 aa, Artificial Sequence
  Q9Y2R5 mitochondrial targeting peptide
MSVVRSSVHARWIVGKVIGT

SEQ ID NO: 707 - protein, 37 aa, Artificial Sequence
  Q9Y2R9 mitochondrial targeting peptide
MAAPAVKVARGWSGLALGVRRAVLQLPGLTQVRWSRY

SEQ ID NO: 708 - protein, 25 aa, Artificial Sequence
  Q9Y2Z2 mitochondrial targeting peptide
MFYFRGCGRWVAVSFTKQQFPLARL

SEQ ID NO: 709 - protein, 16 aa, Artificial Sequence
  Q9Y2Z4 mitochondrial targeting peptide
MAAPILRSFSWGRWSG

SEQ ID NO: 710 - protein, 28 aa, Artificial Sequence
  Q9Y2Z9 mitochondrial targeting peptide
MAARLVSRCGAVRAAPHSGPLVSWRRWS

SEQ ID NO: 711 - protein, 21 aa, Artificial Sequence
  Q9Y305 mitochondrial targeting peptide
MRRAALRLCALGKGQLTPGRG

SEQ ID NO: 712 - protein, 24 aa, Artificial Sequence
  Q9Y375 mitochondrial targeting peptide
MALVHKLLRGTYFLRKFSKPTSAL

SEQ ID NO: 713 - protein, 30 aa, Artificial Sequence
  Q9Y3A0 mitochondrial targeting peptide
MATLLRPVLRRLCGLPGLQRPAAEMPLRAR

SEQ ID NO: 714 - protein, 25 aa, Artificial Sequence
  Q9Y3B8 mitochondrial targeting peptide
MLGGSLGSRLLRGVGGSHGRFGARG

SEQ ID NO: 715 - protein, 20 aa, Artificial Sequence
  Q9Y3D2 mitochondrial targeting peptide
MARLLWLLRGLTLGTAPRRA

SEQ ID NO: 716 - protein, 34 aa, Artificial Sequence
  Q9Y3D3 mitochondrial targeting peptide
MVHLTTLLCKAYRGGHLTIRLALGGCTNRPFYRI

SEQ ID NO: 717 - protein, 62 aa, Artificial Sequence
  Q9Y3E5 mitochondrial targeting peptide
MPSKSLVMEYLAHPSTLGLAVGVACGMCLGWSLRVCFGMLPKSKTSKTHTDTESEASILGDS

SEQ ID NO: 718 - protein, 28 aa, Artificial Sequence
  Q9Y6E7 mitochondrial targeting peptide
MKMSFALTFRSAKGRWIANPSQPCSKAS

SEQ ID NO: 719 - protein, 32 aa, Artificial Sequence
  Q9Y6G3 mitochondrial targeting peptide
MAVAAVKWVMSKRTILKHLFPVQNGALYCVCH

SEQ ID NO: 720 - RNA, 87 nt, Artificial Sequence
  miR-142
gacagugcagucacccauaaaguagaaagcacuacuaacagcacuggaggguguaguguuuccuacuuuauggaugaguguacugug

SEQ ID NO: 721 - RNA, 23 nt, Artificial Sequence
  miR-142-3p
uguaguguuuccuacuuuaugga

SEQ ID NO: 722 - RNA, 23 nt, Artificial Sequence
  miR-142-3p binding site
uccauaaaguaggaaacacuaca

SEQ ID NO: 723 - RNA, 21 nt, Artificial Sequence
  miR-142-5p
cauaaaguagaaagcacuacu

SEQ ID NO: 724 - RNA, 21 nt, Artificial Sequence
  miR-142-5p binding site
aguagugcuuucuacuuuaug

SEQ ID NO: 725 - DNA, 142 bp, Artificial Sequence
  Upstream UTR including miR142-3p
tgataatagtccataaagtaggaaacactacagctggagcctcggtggccatgcttcttgccccttgggcctccccccagcccctcctccccttcctgcacccgtacccccgtggtctttgaataaagtctgagtgggcggc

SEQ ID NO: 726 - DNA, 142 bp, Artificial Sequence
  Upstream UTR including miR142-3p
tgataataggctggagcctcggtggctccataaagtaggaaacactacacatgcttcttgccccttgggcctccccccagcccctcctccccttcctgcacccgtacccccgtggtctttgaataaagtctgagtgggcggc

SEQ ID NO: 727 - DNA, 142 bp, Artificial Sequence
  Upstream UTR including miR142-3p
tgataataggctggagcctcggtggccatgcttcttgccccttccataaagtaggaaacactacatgggcctccccccagcccctcctccccttcctgcacccgtacccccgtggtctttgaataaagtctgagtgggcggc

SEQ ID NO: 728 - DNA, 142 bp, Artificial Sequence
  Upstream UTR including miR142-3p
tgataataggctggagcctcggtggccatgcttcttgccccttgggcctccccccagtccataaagtaggaaacactacacccctcctccccttcctgcacccgtacccccgtggtctttgaataaagtctgagtgggcggc

SEQ ID NO: 729 - DNA, 142 bp, Artificial Sequence
  Upstream UTR including miR142-3p
tgataataggctggagcctcggtggccatgcttcttgccccttgggcctccccccagcccctcctccccttctccataaagtaggaaacactacactgcacccgtacccccgtggtctttgaataaagtctgagtgggcggc

SEQ ID NO: 730 - DNA, 142 bp, Artificial Sequence
  Upstream UTR including miR142-3p
tgataataggctggagcctcggtggccatgcttcttgccccttgggcctccccccagcccctcctccccttcctgcacccgtaccccctccataaagtaggaaacactacagtggtctttgaataaagtctgagtgggcggc

SEQ ID NO: 731 - DNA, 142 bp, Artificial Sequence
  Upstream UTR including miR142-3p
tgataataggctggagcctcggtggccatgcttcttgccccttgggcctccccccagcccctcctccccttcctgcacccgtacccccgtggtctttgaataaagttccataaagtaggaaacactacactgagtgggcggc

SEQ ID NO: 732 - DNA, 2250 bp, Artificial Sequence
  Codon optimized sequence that encodes an MCM polypeptide with the I671V mutation
atgctgcgggccaagaaccagctgttcctgctgagccctcactacctgcggcaggtgaaggagagcagcggcagccggctgatccagcagcggctgctgcaccagcagcagcccctgcaccccgagtgggccgccctggccaagaagcagctgaagggcaagaaccccgaggacctgatctggcacacgcccgagggcatcagcatcaagcccctgtacagcaagcgggacaccatggacctgcccgaggagctgcccggcgtgaagcccttcacccggggcccctaccccaccatgtacaccttccggccctggaccatccggcagtacgccggcttcagcaccgtggaggagagcaacaagttctacaaggacaacatcaaggccggccagcagggcctgagcgtggccttcgacctggccacccaccggggctacgacagcgacaacccacgggtgcggggcgacgtgggcatggccggcgtggccatcgacaccgtggaggacaccaagatcctgttcgacggcatccctctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgcggaacacctacatcttccctcccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagccggaccggcctgcaggccggcctgaccatcgacgagttcgcgccccggctgagcttcttctggggcatcggcatgaacttctacatggagatcgccaagatgcgggccggccggcggctgtgggcccacctgatcgagaagatgttccagcccaagaacagcaagagcctgctgctgcgggcccactgccagaccagcggctggagcctgaccgagcaggacccctacaacaacatcgtgcggaccgccatcgaggccatggccgccgtgttcggcggcacccagagcctgcacaccaacagcttcgacgaggccctgggcctgcccaccgtgaagagcgcccggatcgcccggaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgcggatcgaggagtgcgccgcccggcggcaggcccggatcgacagcggcagcgaggtgatcgtgggcgtgaacaagtaccagctggagaaggaggacgccgtggaggtgctggccatcgacaacaccagcgtgcggaaccggcagatcgagaagctgaagaagatcaagagcagccgggaccaggccctggccgagcggtgcctggccgccctgaccgagtgcgccgccagcggcgacggcaacatcctggccctggccgtggacgccagccgggcccggtgcaccgtgggcgagatcaccgacgccctgaagaaggtgttcggcgagcacaaggccaacgaccggatggtgagcggcgcctaccggcaggagttcggcgagagcaaggagatcaccagcgccatcaagcgggtgcacaagttcatggagcgggagggccggcggccccggctgctggtggccaagatgggccaggacggccacgaccggggcgccaaggtgatcgccaccggcttcgccgacctgggcttcgacgtggacatcggcccactgttccagacgccccgggaggtggcccagcaggccgtggacgccgacgtgcacgccgtgggcgtgagcaccctggccgccggccacaagaccctggtgcccgagctgatcaaggagctgaacagcctgggccggcccgacatcctggtgatgtgcggcggcgtgatcccgccccaggactacgagttcctgttcgaggtgggcgtgagcaacgtgttcggccccggcacccggatccccaaggccgccgtgcaggtgctggacgacatcgagaagtgcctggagaagaagcagcagagcgtg

SEQ ID NO: 733 - DNA, 2250 bp, Artificial Sequence
  Codon optimized sequence that encodes an MCM polypeptide with the I671V mutation
atgctgcgggccaagaaccagctgttcctgctgagcccgcactacctgcggcaggtgaaggagagcagcggcagccggctgatccagcagcgcctcctccaccagcagcagcccctccaccccgagtgggccgccctcgccaagaagcagctcaagggcaagaaccccgaggacctcatctggcacacgcccgagggcatctccatcaagcccctctactccaagcgcgacaccatggacctccccgaggagctccccggcgtcaagcccttcacccgcggcccctaccccaccatgtacaccttccgcccctggaccatccgccagtacgccggcttctccaccgtcgaggagtccaacaagttctacaaggacaacatcaaggccggccagcagggcctctccgtcgccttcgacctcgccacccaccgcggctacgactccgacaacccgcgcgtccgcggcgacgtcggcatggccggcgtcgccatcgacaccgtcgaggacaccaagatcctcttcgacggcatccctctcgagaagatgtccgtctccatgaccatgaacggcgccgtcatccccgtcctcgccaacttcatcgtcaccggcgaggagcagggcgtccccaaggagaagctcaccggcaccatccagaacgacatcctcaaggagttcatggtccgcaacacctacatcttccctcccgagccctccatgaagatcatcgccgacatcttcgagtacaccgccaagcacatgcccaagttcaactccatctccatctccggctaccacatgcaggaggccggcgccgacgccatcctcgagctcgcctacaccctcgccgacggcctcgagtactcccgcaccggcctccaggccggcctcaccatcgacgagttcgcgccccgcctctccttcttctggggcatcggcatgaacttctacatggagatcgccaagatgcgcgccggccgccgcctctgggcccacctcatcgagaagatgttccagcccaagaactccaagtccctcctcctccgcgcccactgccagacctccggctggtccctcaccgagcaggacccctacaacaacatcgtccgcaccgccatcgaggccatggccgccgtcttcggcggcacccagtccctccacaccaactccttcgacgaggccctcggcctccccaccgtcaagtccgcccgcatcgcccgcaacacccagatcatcatccaggaggagtccggcatccccaaggtcgccgacccctggggcggctcctacatgatggagtgcctcaccaacgacgtctacgacgccgccctcaagctcatcaacgagatcgaggagatgggcggcatggccaaggccgtcgccgagggcatccccaagctccgcatcgaggagtgcgccgcccgccgccaggcccgcatcgactccggctccgaggtcatcgtcggcgtcaacaagtaccagctcgagaaggaggacgccgtcgaggtcctcgccatcgacaacacctccgtccgcaaccgccagatcgagaagctcaagaagatcaagtcctcccgcgaccaggccctcgccgagcgctgcctcgccgccctcaccgagtgcgccgcctccggcgacggcaacatcctcgccctcgccgtcgacgcctcccgcgcccgctgcaccgtcggcgagatcaccgacgccctcaagaaggtcttcggcgagcacaaggccaacgaccgcatggtctccggcgcctaccgccaggagttcggcgagtccaaggagatcacctccgccatcaagcgcgtccacaagttcatggagcgcgagggccgccgcccgcgcctcctcgtcgccaagatgggccaggacggccacgaccgcggcgccaaggtcatcgccaccggcttcgccgacctcggcttcgacgtcgacatcggcccactcttccagacgccccgcgaggtcgcccagcaggccgtcgacgccgacgtccacgccgtcggcgtctccaccctcgccgccggccacaagaccctcgtccccgagctcatcaaggagctcaactccctcggccgccccgacatcctcgtcatgtgcggcggcgtcatccctccccaggactacgagttcctcttcgaggtcggcgtctccaacgtcttcggccccggcacccgcatccccaaggccgccgtccaggtcctcgacgacatcgagaagtgcctcgagaagaagcagcagtccgtc

SEQ ID NO: 734 - DNA, 2250 bp, Artificial Sequence
  Codon optimized sequence that encodes an MCM polypeptide with the I671V mutation
atgctgcgggccaagaaccagctgttcctgctgagcccccactacctgcggcaggtgaaggagagcagcggcagccggctgatccagcagcggctgctgcaccagcagcagcccctgcaccccgagtgggccgccctggccaagaagcagctgaagggcaagaaccccgaggacctgatctggcacacccccgagggcatcagcatcaagcccctgtacagcaagcgggacaccatggacctgcccgaggagctgcccggcgtgaagcccttcacccggggcccctaccccaccatgtacaccttccggccctggaccatccggcagtacgccggcttcagcaccgtggaggagagcaacaagttctacaaggacaacatcaaggccggccagcagggcctgagcgtggccttcgacctggccacccaccggggctacgacagcgacaacccccgggtgcggggcgacgtgggcatggccggcgtggccatcgacaccgtggaggacaccaagatcctgttcgacggcatccccctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgcggaacacctacatcttcccccccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagccggaccggcctgcaggccggcctgaccatcgacgagttcgccccccggctgagcttcttctggggcatcggcatgaacttctacatggagatcgccaagatgcgggccggccggcggctgtgggcccacctgatcgagaagatgttccagcccaagaacagcaagagcctgctgctgcgggcccactgccagaccagcggctggagcctgaccgagcaggacccctacaacaacatcgtgcggaccgccatcgaggccatggccgccgtgttcggcggcacccagagcctgcacaccaacagcttcgacgaggccctgggcctgcccaccgtgaagagcgcccggatcgcccggaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgcggatcgaggagtgcgccgcccggcggcaggcccggatcgacagcggcagcgaggtgatcgtgggcgtgaacaagtaccagctggagaaggaggacgccgtggaggtgctggccatcgacaacaccagcgtgcggaaccggcagatcgagaagctgaagaagatcaagagcagccgggaccaggccctggccgagcggtgcctggccgccctgaccgagtgcgccgccagcggcgacggcaacatcctggccctggccgtggacgccagccgggcccggtgcaccgtgggcgagatcaccgacgccctgaagaaggtgttcggcgagcacaaggccaacgaccggatggtgagcggcgcctaccggcaggagttcggcgagagcaaggagatcaccagcgccatcaagcgggtgcacaagttcatggagcgggagggccggcggccccggctgctggtggccaagatgggccaggacggccacgaccggggcgccaaggtgatcgccaccggcttcgccgacctgggcttcgacgtggacatcggccccctgttccagaccccccgggaggtggcccagcaggccgtggacgccgacgtgcacgccgtgggcgtgagcaccctggccgccggccacaagaccctggtgcccgagctgatcaaggagctgaacagcctgggccggcccgacatcctggtgatgtgcggcggcgtgatccccccccaggactacgagttcctgttcgaggtgggcgtgagcaacgtgttcggccccggcacccggatccccaaggccgccgtgcaggtgctggacgacatcgagaagtgcctggagaagaagcagcagagcgtg

SEQ ID NO: 735 - DNA, 2250 bp, Artificial Sequence
  Codon optimized sequence that encodes an MCM polypeptide with the I671V mutation
atgctgagggccaagaaccagctgttcctgctcagcccccactacctgcgccaggtgaaggagtcctccggctcccggctgatccagcagaggctcctgcaccagcagcaacccctgcatccggagtgggccgccctcgccaagaaacagttgaaaggcaagaaccccgaggatctcatctggcatacccccgagggcatcagcatcaagccgctgtacagcaagagggacaccatggatctcccggaagagctgcctggcgtgaagcccttcacccggggtccctaccccacgatgtacaccttccgcccctggaccatcaggcagtacgcgggctttagcacggtcgaggagagcaacaaattctacaaggacaacatcaaggcgggccagcagggcctgagcgtggccttcgacctagccacccaccggggctatgacagcgacaacccacgggtcaggggcgacgtgggcatggcgggcgtggccatagacaccgtggaggacaccaagatcctgttcgacgggatcccacttgagaagatgagcgtgtccatgaccatgaacggcgccgtcatccccgtgctggccaacttcatcgtgaccggcgaggagcagggcgtgcccaaggagaagctgaccggcaccatacagaacgacatcctgaaggagtttatggtgcgcaacacctatatcttcccccccgaacccagcatgaagatcatcgccgacatcttcgagtacaccgcgaagcacatgcccaagttcaactccatcagcatcagcggctaccatatgcaggaggccggtgcggacgccatcctggagcttgcctacaccctggccgacgggctggagtacagcaggaccgggctccaggccggtctgaccatcgacgaattcgcccccaggctgagcttcttctggggcatcggcatgaacttctacatggagatcgccaaaatgagggccggcaggaggctctgggcccacctgatcgaaaaaatgttccagcccaaaaacagcaaatccctgctgctgcgggcccactgccagaccagcggctggagcctcaccgagcaagacccctataataacatcgtcaggacggccatcgaagcgatggccgccgtgttcggaggcacccagagcctccataccaacagcttcgacgaggccctggggctgccgacggtgaaaagcgccaggatcgccaggaacacgcagatcatcatccaggaggagagcggtatccccaaggtggccgacccgtggggtggcagctacatgatggagtgcctcacgaacgacgtgtatgacgccgcgctgaaactgatcaacgagatcgaggagatgggggggatggccaaggccgtggctgagggtattcccaagctgcgcatagaggagtgcgccgccaggcgccaggccaggatcgactccgggtccgaggtaatcgtcggcgtgaacaagtaccagctggagaaggaggacgccgtggaggtgctggcaatcgacaacaccagcgtgaggaaccggcagatcgaaaagctgaagaagattaaaagcagccgggaccaagccctggcagagaggtgcctggccgccctgacggaatgcgccgcctccggggacggcaacatcctggctctggccgtggacgctagccgcgccaggtgcaccgtcggcgagatcaccgacgccctgaagaaggtgttcggggagcacaaggcgaacgaccgcatggtgtccggcgcctatcggcaagagttcggggagagcaaggaaataaccagcgccatcaaacgtgtgcacaagttcatggaaagggagggcaggcgcccgaggctcctcgtcgccaagatgggccaggatgggcacgacaggggagccaaagtcatcgccaccgggtttgcggacctggggttcgacgtggacatcggccccctgttccagacgccgagggaggtggcccaacaggccgtggacgccgacgtgcacgccgtgggcgtgagcacgctcgccgcggggcacaagaccctggtgcccgagctgattaaggagctgaacagcctgggccgacccgacatcctggtgatgtgcgggggcgtgatccccccgcaggactacgaattcctgttcgaggtgggagtcagcaacgtgttcgggcccggtacgaggatcccgaaggccgccgtgcaggtgctggacgacatcgagaaatgcctggagaagaaacagcagtccgtg

SEQ ID NO: 736 - DNA, 2250 bp, Artificial Sequence
  Codon optimized sequence that encodes an MCM polypeptide with the I671V mutation
atgctgcgggccaaaaaccagctgttcctgctctccccccactacctgcggcaggtgaaggagagctccggaagcaggctcatacagcagcgcctgctccaccagcagcagcccctgcaccccgagtgggccgctctggctaagaaacagctgaagggcaaaaatcccgaggacctgatctggcatacccccgagggcatcagcatcaaacccctgtatagcaaacgggacaccatggacctcccggaggagctgcccggagttaagcccttcaccaggggcccctatccaacaatgtacaccttccggccctggaccatccgacagtacgccggcttcagcacggtcgaggagtccaacaagttctataaggacaacatcaaggccgggcagcagggcctgagcgtcgccttcgacctggccacccaccgtgggtacgacagcgacaaccccagggtgcggggcgacgtgggcatggccggcgtggccatagataccgtggaggacaccaagatcctgtttgacggcatccccctggagaagatgagcgtgtccatgacaatgaacggcgccgtgatccccgtgctcgccaatttcatagtgaccggcgaggagcagggcgtgccgaaggagaagttgaccggaacaatccagaacgacatcctgaaggagttcatggtgcggaacacctacatcttcccccccgagccgtcaatgaagatcatcgccgacatcttcgagtacaccgccaagcacatgcccaagttcaacagcatcagcatcagcggctatcatatgcaggaggccggggccgacgccatcctggagctggcttacacgctggccgacggcctggagtattccaggaccggcttacaagccggcctgaccatcgacgagttcgcccccaggctgagcttcttctggggcatcggcatgaacttttacatggagatcgccaagatgcgagccggcaggcggctgtgggcccacctgattgagaaaatgttccagcccaagaactctaagtccctgctgctgcgagcccactgccagaccagcggctggagcctgaccgagcaggacccctacaacaatatcgtgcgcaccgccatcgaagcgatggccgccgtgtttggcggcactcagagcctgcacaccaactcctttgacgaggccctgggcctgcccaccgtgaagagtgccaggatagcgaggaacacccaaatcataatacaggaggagtccgggatccccaaggtggccgacccctggggcggctcctacatgatggagtgcctgaccaacgatgtctacgacgccgccctgaaactgatcaacgagatcgaggagatgggaggcatggccaaggccgtggctgagggcatccccaagctgaggatcgaggagtgcgcagcccgtcgtcaggcccgcatcgacagcggctccgaggtgatcgtcggcgtgaacaagtaccagctcgaaaaagaggatgccgtggaagtgctggccatcgacaacacgtccgtccgcaataggcagatcgagaaactgaagaagatcaagtcgtccagggaccaggccctggccgagagatgcctggccgccctgacggaatgcgccgccagcggggatggcaatatcctggccctggccgtggacgcctcccgggccaggtgcacagtgggggagatcaccgacgcgctcaagaaggtgtttggcgagcacaaggccaacgataggatggtgagcggcgcgtacaggcaggagttcggcgagtccaaggagatcaccagcgccatcaagagagtgcacaagttcatggagcgggaggggcggaggccgaggctgctcgtggcgaagatgggccaagacgggcacgacaggggcgccaaggttatcgccaccgggtttgcagacctgggcttcgacgtggacatcggccccctctttcagaccccccgagaagtggcacaacaggccgtggacgccgacgtgcacgccgtgggcgtaagcaccctggccgccggccataaaaccctggtgccggagctgatcaaggagctcaacagcctgggccgacccgacatcctggtgatgtgtgggggtgtgattcctccccaggattacgagttcctgttcgaggtgggcgtgagcaatgtcttcggcccggggaccaggatacccaaggcggccgtccaggtgctcgacgacattgagaagtgcctcgagaagaaacagcagtccgtg

SEQ ID NO: 737 - DNA, 2250 bp, Artificial Sequence
  Codon optimized sequence that encodes an MCM polypeptide with the I671V mutation
atgctcagagccaaaaaccagctgttcctgctcagcccccactatctgaggcaggtgaaggagagctcagggtccaggctgatccaacagcgcctgctccaccaacagcagccgctccatcccgagtgggccgccctggccaagaaacagctgaaggggaagaatcctgaggacctgatctggcacacccccgagggaatcagcatcaagcccctgtactccaagagggacaccatggacctgcccgaggagctgccgggcgtgaagccctttaccaggggaccctacccgacgatgtacacctttcggccctggaccatcaggcagtacgccggcttctccaccgtggaggagagcaacaagttctacaaggacaacatcaaagcgggccaacagggtctgagcgtggccttcgatctggccacgcacaggggctacgacagcgacaaccccagggtccggggcgacgtgggcatggccggcgtggccatcgacacggtggaggacaccaagatcctgttcgacggcatccccctggagaaaatgtccgttagcatgaccatgaatggggccgtcatcccggtgctggccaacttcatcgtgaccggggaggagcagggagttcccaaggagaaactcaccgggaccatacagaacgacatcctgaaggaatttatggtcaggaacacctatatatttccccccgagcccagcatgaagatcatcgccgacatatttgagtacaccgccaagcacatgcccaagttcaacagcatcagtatcagcgggtatcacatgcaggaggccggcgccgacgccatcctggagctggcgtacaccctcgccgacggcctggagtacagccggaccgggctccaggccggcctcaccatcgatgagttcgccccccgcctgtcgtttttctggggcatcgggatgaatttctacatggagatcgcgaagatgcgcgccggcaggaggctgtgggcgcacctcatcgagaaaatgttccagcccaagaactccaagagcctgctgctgcgggcacactgccagacctcgggttggtccctgaccgagcaggacccctacaacaatatcgtgaggaccgccatcgaagccatggccgccgtcttcggcggcacccagagcctgcacaccaacagcttcgacgaggccctgggccttcccaccgtgaagtccgcaaggatcgcccggaacacccaaatcatcatccaggaggaaagcggcatccccaaggtggccgacccctgggggggctcctacatgatggagtgcctgaccaacgacgtgtacgacgccgccctcaagctgatcaacgagatcgaggagatgggcggcatggccaaggccgtggccgagggcatccccaagctgcggatcgaggagtgcgccgccaggaggcaggcccggatagactccggcagcgaagtgatcgtgggcgtcaataaataccagctggagaaagaggacgccgtggaggtgctcgccatcgacaacacgagcgtgcggaacaggcagatcgagaaactcaagaagatcaaaagctcgagggaccaagccctggccgagaggtgcctggccgccctgaccgagtgcgccgccagtggggacggcaacatcctggccctggccgtcgacgccagccgcgccagatgcacggtgggcgagatcaccgacgccctgaagaaggtcttcggcgagcataaggccaacgacaggatggtgtccggggcctacaggcaagagtttggggagtccaaagagatcacctcggccatcaagcgggtgcacaagttcatggaaagggaaggcaggcggcccaggctgctcgtagccaagatgggtcaagacggccacgacaggggcgccaaagtcatcgccaccggctttgccgacctgggtttcgacgtggatatcggcccgctgttccagacccccagggaggtggcccagcaggcggtggacgccgacgtacatgccgtgggcgtgtccaccctggcggccggccacaagacgctggtgcccgagctgatcaaggagctcaacagcctgggaaggcccgacatcctggtcatgtgcggcggcgtgatcccgccccaggattacgagttcctgtttgaggtgggggtgtccaacgtctttggccccggcaccaggatccccaaggcggccgtgcaggtgctggacgatatcgagaaatgtctcgaaaagaagcagcagtccgtg

SEQ ID NO: 738 - DNA, 2250 bp, Artificial Sequence
  Codon optimized sequence that encodes an MCM polypeptide with the I671V mutation
atgcttcgagccaagaaccagctgttcctcctcagcccccactacctccggcaggtcaaggaaagcagcggctcccggctgatccagcagaggctgctccatcagcagcagcccctgcaccccgagtgggcggccctggccaagaagcagctcaagggcaaaaaccccgaggacctgatctggcatacccccgagggcataagcatcaaacccctgtacagcaagagggacaccatggacctcccggaggagctgcccggtgtgaagcccttcaccaggggcccttatccgaccatgtacaccttcaggccctggaccatcaggcaatatgccgggttcagcaccgtggaggagagcaacaagttctataaggataacatcaaggccggccagcaaggcctcagcgtagccttcgacctggccacccataggggatacgacagcgacaatccccgggtgcggggcgacgtggggatggccggcgtggcgatcgataccgtggaggacacaaaaatcctcttcgacgggatccccctggagaaaatgagcgtgtccatgaccatgaacggcgcggtgatcccggtgctggccaattttatagtcaccggggaggagcaaggcgtacccaaggagaagctgaccgggaccatccagaacgacatcctgaaggagttcatggtcaggaacacctacatcttccccccagagccgagcatgaagatcatcgccgacatatttgagtacaccgccaagcacatgcccaagttcaacagcatcagcataagcggctaccatatgcaggaggccggcgccgacgccatcctggagctggcctacaccctggccgacggcctcgagtattccaggaccgggctgcaggccggactgaccatcgacgagttcgcgccccggctgtccttcttctgggggatagggatgaacttctacatggagatcgccaagatgagggccggccggcggctgtgggcccacctgatcgaaaagatgttccagcccaagaactcaaaaagcctgttgctgcgcgcccactgccagacctccgggtggtcacttaccgaacaggacccctataataacatcgtcaggaccgccatcgaggccatggccgccgtgtttggcggcacccagtccctccacacgaactctttcgacgaggccctggggctcccgaccgtgaagagcgcgaggatcgcaaggaacacccagataatcatccaggaggaaagcggcatccccaaggttgccgacccctggggcggcagctatatgatggagtgcctgaccaacgacgtctacgatgcggccctgaagctgatcaacgaaatcgaagagatgggcggaatggccaaggccgtggccgagggtatccccaagctccggatcgaggagtgcgccgcccgccgacaggccaggatcgacagcgggtccgaggtgatcgtgggggtgaacaagtaccagctggaaaaggaggacgccgtggaggtgctggccatcgacaacacctcagtgaggaataggcagatcgaaaagctgaagaagatcaaaagctccagggaccaggccctggccgagaggtgcctggccgcactcaccgagtgcgccgcctccggcgacggaaacatcctcgccctggccgtggacgcctcccgagccaggtgcaccgtcggggagatcaccgatgccctgaagaaggtgtttggcgagcacaaggccaacgacaggatggtgtcgggcgcctacaggcaagagttcggggagagcaaggagatcactagcgccatcaagagggtgcacaagttcatggagcgggagggccggaggccccgtctgctggtggccaagatgggccaggacgggcacgaccgcggcgccaaggtgatcgccaccggcttcgccgacctggggtttgacgtggacatcggccccctgttccagacccccagggaggtagcccagcaagccgtggacgccgacgtgcacgccgtgggagtgagtaccctggccgccggccacaagaccctggtgcccgagctgattaaagagcttaacagccttggccggcccgacatcctggtgatgtgcggtggcgtcatcccgccccaggactacgagttcctgttcgaagtgggcgtgtccaacgtgttcggcccgggcacccgcatccccaaggccgccgtgcaggtgctcgacgacatcgagaaatgtctggagaagaagcagcagtccgtg

SEQ ID NO: 739 - DNA, 2250 bp, Artificial Sequence
  Codon optimized sequence that encodes an MCM polypeptide with the I671V mutation
atgctgagggccaagaaccagctgttcctcctgagcccccactacctgaggcaagtgaaggagtcctccggctccaggctgatccagcagcgactgctgcaccagcagcagcccctccaccccgagtgggccgctctcgccaagaagcagctgaagggcaagaaccccgaggacctgatatggcacaccccggagggcatctcgatcaagcccctgtattccaaacgggacactatggacctgccggaggagctgcccggcgtcaagccctttacgcggggcccctaccccaccatgtacaccttccgaccgtggaccatcaggcagtacgccggctttagcaccgtggaggagtccaacaagttctacaaggacaacatcaaggccggccagcagggcctgagcgtggcgttcgacctggccacacacaggggctacgacagcgacaaccccagggtgaggggcgacgtgggcatggccggggtggccatcgacaccgtggaggacaccaagatcctgttcgacggcatccccctggagaagatgagcgtgagcatgacaatgaatggggccgtgatccccgtgctggccaatttcatcgtcaccggggaggaacagggcgtgcctaaggaaaagctgacaggcaccatccagaacgacatcctcaaggagttcatggtgcggaacacctacatcttcccccccgagcccagcatgaagatcattgcagacatctttgagtacaccgccaagcacatgcccaagttcaacagcatctccatctcgggctaccacatgcaggaagcgggggcggacgccatcctcgagctggcctatacgctggctgatggcctggagtactccaggactggtctgcaggcgggcctgacgatcgacgagtttgcacccaggctatccttcttttggggaatcggcatgaacttttacatggagatcgccaaaatgcgggcgggccgccgcctgtgggcccacctgatcgaaaagatgtttcagcccaagaactccaagagcctgctgctgagggcccactgccagacctccgggtggagcctgactgagcaggacccatacaacaacatcgtgcggaccgcgatcgaggccatggccgccgtgttcggcggcacccagagcctgcacaccaattctttcgacgaggccctgggactccccaccgtgaagtccgccaggatcgccaggaatacccagatcatcatccaggaggagtccggcatacccaaggtggccgacccgtggggcggtagctacatgatggagtgcctgaccaacgacgtctacgacgccgccctgaagctgatcaacgagatcgaggaaatgggcggcatggccaaagcggtcgccgaagggatcccgaagctgaggatcgaagagtgcgccgccaggcggcaggccaggatcgacagtggctccgaggtgatcgtgggcgtgaacaaataccagctggagaaggaggatgccgttgaggtgctcgccatcgataacacctccgtgcggaatcggcagatcgagaagctgaaaaagatcaaaagcagccgggaccaggccctcgcggagaggtgtctggccgccctgaccgagtgcgccgcgagcggcgacgggaacatcctcgccctggccgtggacgcctcacgggcccgatgcaccgtgggcgagatcaccgacgccctcaagaaggtgttcggggagcataaggcgaacgacaggatggtgtcaggggcctacaggcaggagttcggggagtccaaggaaattacctccgccatcaagagagtccacaaattcatggaacgggagggcaggaggcccaggctgctggtggccaagatgggtcaggacggccacgacaggggcgccaaggtgatcgccaccgggttcgccgacctcgggttcgatgtcgacatcgggcccctgttccagacccccagggaagtggcccaacaggccgtggacgccgacgtgcacgccgtgggcgtgagcaccctggccgccggacacaagaccctggtgcccgagctgataaaggagctgaacagcctggggcgacccgacatcctcgtgatgtgcggtggggtgatcccgccgcaggactacgagttcctgttcgaggtgggcgtgtccaacgtgtttgggcccgggacccggatcccgaaggccgccgtgcaggtgctggatgatatagagaagtgcctggagaagaagcagcagagcgtg

SEQ ID NO: 740 - DNA, 2250 bp, Artificial Sequence
  Codon optimized sequence that encodes an MCM polypeptide with the I671V mutation
atgctgcgcgccaagaaccagctgttcctgctgtccccgcattacctgaggcaggtgaaggagtccagcgggtcccgtctgatccagcagaggctgctgcaccagcagcagcccctgcaccccgagtgggccgctctggctaagaagcagctgaagggtaaaaaccccgaggacctgatctggcacacccccgaaggcatctccatcaagcccctctacagcaagagggatactatggacctgcccgaggagctgcccggcgtcaagccctttaccaggggcccctatccgaccatgtacacgtttcgcccctggaccatcaggcagtacgctggcttcagcaccgtggaggaaagcaataagttttacaaggacaacatcaaggccgggcagcagggtctgagcgtggccttcgacctcgccacccaccgcggctacgactccgacaacccccgggtgcggggcgacgtgggcatggccggggtggccatcgacaccgtggaggacaccaagatactcttcgatgggatccccctggagaagatgtcagtctcgatgaccatgaacggcgccgtgattcccgtgctggccaactttatcgtgaccggggaagagcagggggtgcccaaagaaaaactgaccgggaccattcagaacgatatcctcaaggagtttatggtgcgcaatacctacatcttcccccccgaacccagcatgaagatcatcgcggacatctttgagtataccgccaagcacatgccgaagttcaatagcataagcatttccggttatcacatgcaggaagccggcgccgatgcgatcctggagctggcctacaccctggccgatggcctcgagtactcccgaacggggctgcaggccgggctcacgatcgatgagttcgcccccaggctgtccttcttctggggaatcggcatgaacttttacatggagatcgccaagatgagggccggcaggcgactgtgggcgcacctgattgaaaaaatgtttcagcccaagaactcgaagagcctcctactgcgggcccactgccaaaccagcggctggagcctgaccgagcaagacccctacaacaatatcgtgaggaccgccatagaggcgatggccgccgtgttcggagggacccagagcctgcacaccaactccttcgacgaggccctgggcctgcccaccgtgaagagcgccaggatcgcccgcaacacccagatcatcatccaggaggaaagcggcatccccaaggtggccgacccctggggtggctcctacatgatggagtgcctgaccaacgacgtctacgacgccgcgctgaagctcataaacgagatagaggagatgggcgggatggccaaggccgtggccgagggcatccccaaactgaggatcgaggagtgcgccgccaggaggcaggcccgcatcgactccgggagcgaggtaatcgtgggcgtgaacaagtaccaactggagaaggaggacgccgtcgaggtgctggccatcgacaacacctccgtgcgaaacaggcagatcgagaagctgaaaaagatcaagagctcaagagaccaggcactggctgagaggtgcctggccgccctcaccgagtgcgcagccagcggcgacggcaacatactggccctggccgtggacgcaagcagggcccgttgcaccgtgggcgagatcaccgacgccctgaagaaagtgttcggcgagcacaaggcgaacgaccggatggtgagcggcgcgtacaggcaggagttcggcgaatccaaggagatcacctccgccatcaagcgagtgcacaagtttatggagcgggagggccgccgccccaggctgctggtcgcgaagatgggacaggacggacacgacaggggcgccaaagtgatcgccaccggcttcgccgaccttggattcgacgtggacataggccccctgttccagaccccccgagaggtggcgcagcaagccgtagatgccgatgtgcatgccgtgggtgtgtccaccctggcggccggccacaaaaccctggtgcccgagctgatcaaggagctgaactccctgggccggcccgacatcctcgtgatgtgcgggggcgttatccccccgcaggactatgagttcctgttcgaagtcggggtgtccaacgtgttcggccccggcacgaggatccccaaggccgccgtgcaagtcctggacgacatcgaaaagtgcctggagaagaagcagcaaagcgtg

SEQ ID NO: 741 - DNA, 2250 bp, Artificial Sequence
  Codon optimized sequence that encodes an MCM polypeptide with the I671V mutation
atgctgcgggccaagaatcagctgttcctgctgagcccccactacctgaggcaggtgaaagagtcctccggctccaggctgatccagcagcgactgctgcatcagcaacagccgctgcaccccgagtgggccgccctggccaagaagcagctgaagggcaagaatcccgaggacctgatctggcacaccccggaaggcatcagcatcaagcccctgtacagcaaacgcgatacgatggacctgccggaggagctgccgggcgtgaagccgttcacccgcgggccctaccccaccatgtacacctttcgcccctggaccatccggcagtacgccggcttcagcacggtcgaggagagcaacaagttctacaaagacaacatcaaggccggccagcagggcctctccgtcgccttcgacctggccacccacaggggttacgacagcgataatccacgggtgaggggcgacgtggggatggctggggtggccatcgacaccgtggaggataccaagatcctgttcgacggcatccccctggagaagatgagcgtgagcatgaccatgaacggcgccgtcatccccgtgctggccaacttcatcgtgaccggcgaggagcaaggggtgcccaaagagaagctcaccggaaccatccagaacgacatcctgaaggagttcatggtccggaacacctacatatttccccccgagcccagcatgaagatcatcgccgatatcttcgagtacaccgccaagcacatgcccaagttcaacagcatctccatctccggctaccacatgcaggaggcaggggccgatgccatcctggagctggcctataccctggccgacggcctggagtacagccggaccggcctccaggccggtctgaccatcgatgagttcgcccccaggctgtcgtttttttggggcatcggcatgaacttctacatggaaatcgccaagatgagggccggccggaggctgtgggcccacctgatcgagaagatgttccagcccaaaaacagcaagtccctgctcctgcgtgcccactgccagaccagcgggtggagcctgacggagcaggacccctacaacaacatcgtgaggacggccatcgaggccatggccgccgtttttggcggcacccagagcctgcacacaaacagcttcgacgaggccctgggactgcccaccgtgaagtcggcccggatcgcccgaaacacccagatcatcatacaggaggaaagcggcatccccaaggtggccgacccctgggggggaagctacatgatggagtgcctgaccaacgacgtgtacgacgctgccctgaaactgatcaatgagatcgaggagatgggcggcatggccaaggccgtggccgaagggatcccgaagctgcggatcgaggaatgcgcggcccggaggcaggccaggatcgacagcggcagcgaagtgatcgtgggggtcaataaatatcagctggaaaaggaggatgcggtcgaagtcctggccatcgacaacaccagcgtgcggaaccgccagatagagaagctgaaaaagatcaagtccagccgggaccaggccctggccgaaaggtgtctcgccgccctcaccgagtgcgcggcaagcggggacggcaacatcctggccctggccgtggacgccagccgagccaggtgcaccgtgggtgaaataaccgacgccctgaagaaggttttcggcgagcacaaggccaacgaccgtatggtgagcggcgcctatcggcaggaattcggcgagtccaaggagatcacctccgccatcaagagggtgcacaagttcatggagcgcgagggacggcgaccgcggctgctggtggccaagatgggccaagacgggcacgacaggggcgccaaggtgatcgccaccggattcgcggacctggggttcgacgtggacatcgggcccctgttccagaccccacgggaggtggcccaacaggccgttgatgcggacgtgcacgcggtgggcgtctccaccctggccgccggccacaagaccctcgtgccagagctgatcaaggagctgaacagcctgggcagaccagatatcctggtcatgtgcgggggggtgatcccgccccaggactacgagttcctgttcgaggtgggcgtgagcaatgttttcggccctgggaccagaatccccaaggccgccgtgcaggtgctggacgacatcgaaaagtgcctcgagaagaagcagcagagcgtg

SEQ ID NO: 742 - DNA, 2250 bp, Artificial Sequence
  Codon optimized sequence that encodes an MCM polypeptide with the I671V mutation
atgctgagggccaagaaccagttgtttctgctctccccccactacctgaggcaggtgaaagaaagctccggcagcaggctgatccagcagaggctcctgcaccagcagcaaccgctccatcccgagtgggcagccctggcgaagaaacagctgaaagggaagaaccccgaggatctgatctggcacacccccgaggggatcagcatcaagccgctgtacagcaaacgggacaccatggatctgcccgaagagctgccgggcgtgaagcccttcaccagggggccctaccccaccatgtataccttcaggccctggaccatacggcagtacgccggcttctccactgtggaagagtcgaataagttctacaaggataacatcaaggccggccaacagggcctgagcgtggcctttgacctggccacccatcgcgggtatgacagtgataaccctcgggtgcgtggcgacgtgggtatggccggcgtggccattgacaccgtggaggacacgaagatcctcttcgacggcatccccctggagaagatgagcgtgagcatgaccatgaacggcgccgtgattcccgtgctcgccaatttcatcgtcaccggcgaggagcagggcgtgcctaaggagaagctgaccgggaccatccagaatgacatcctgaaggagtttatggtgaggaacacctacatcttcccgcccgaacccagcatgaagatcatcgccgacatcttcgagtacacagccaagcacatgcccaagttcaactccatcagcatctccggataccatatgcaggaagccggggccgatgcgatccttgagctggcctataccctggccgacggcctggagtactccaggaccggcctgcaagccgggctgacaatcgatgagttcgccccccgactgagcttcttctggggcatcggcatgaacttttacatggagatcgccaaaatgcgggctgggaggaggctctgggcccacttgatcgagaagatgtttcagcccaagaactccaagagcctgctcctgagggcccactgccagacgagcggttggtccctcaccgagcaggacccctacaacaacatcgtgaggaccgccatcgaggccatggccgccgtgttcggcgggacgcagagcctccacaccaactcctttgacgaggccctggggctgcccacggtcaagagcgcacgcatagccaggaacacccaaatcatcatccaggaggagagcggaatccccaaggtcgcggacccatgggggggaagctacatgatggagtgcctgaccaacgacgtatacgacgccgccctgaaactgatcaatgagatagaagagatggggggaatggccaaagccgtggccgagggcatcccgaagctgaggatcgaagaatgtgccgccaggaggcaggcccggatcgacagcggcagcgaggtcatcgtcggggtgaataaataccaactggagaaggaggacgccgtggaggtcctggccatcgacaatacaagcgtgcgcaatcggcagattgagaagctgaagaagatcaagagcagcagggaccaggcgctggcagagcggtgtctggccgccctgaccgaatgcgccgccagcggggacggaaacatcctggccctggccgtggatgcctcccgggccaggtgcaccgtcggcgagatcaccgacgctctgaagaaggtcttcggcgagcacaaggctaacgaccggatggtgagcggcgcctaccggcaggagttcggcgagagcaaggagatcacctccgccatcaagcgggtgcacaagtttatggaacgcgagggccgcagacccaggctcctcgtggccaagatgggccaggatggccacgacaggggggccaaggtcatcgccaccggattcgccgatctgggcttcgacgtggacatcgggcccctgtttcaaacgccccgcgaagtagcacagcaggccgtggacgccgacgtgcacgccgtgggcgtgtccaccctggccgccggccataagaccctggtgcccgagctgatcaaggagctgaacagcctggggcgcccggatatactcgtgatgtgcgggggcgtcatccccccccaggattacgagtttctcttcgaggtgggggtgagcaacgtctttggccccggaacccgaatccccaaggccgccgtgcaggtgctcgacgatatagagaagtgcctggagaaaaagcagcagtccgtg

SEQ ID NO: 743 - DNA, 2250 bp, Artificial Sequence
  Codon optimized sequence that encodes an MCM polypeptide with the I671V mutation
atgctgagggccaagaaccagctcttcctgctgtccccccactacctgcggcaggtgaaggagagctccggcagccgcctgatccaacagcggctgctgcaccagcagcaaccgctgcaccccgagtgggccgccctggccaagaaacagctcaaggggaagaaccccgaggacctgatctggcacacccccgagggcatttccatcaaacccctgtacagcaagagggacaccatggacctgcccgaggaactgccgggagtgaagcccttcacccgcggcccctatcccaccatgtacaccttcaggccgtggaccatccgccagtatgccggctttagcaccgtggaggagagcaacaagttctacaaagacaacatcaaggcagggcagcagggcctgagcgtggccttcgatctggccacccataggggctacgacagcgacaacccgagggtgaggggggacgtgggcatggccggcgtggccatcgataccgtggaggataccaagatcctgtttgacggcatccccctggagaagatgtccgtgagtatgaccatgaacggcgcggtgatcccggtgctggccaacttcatcgtgaccggcgaggaacagggcgtgccaaaggagaagctgaccggcaccatccagaacgacatactcaaagagttcatggtacggaacacctacatcttcccccccgagccctcgatgaagatcatcgccgacatcttcgagtacaccgccaagcacatgcccaagttcaactccatctccatctcgggctatcacatgcaggaagccggggccgacgccatcctggaactggcctacactctggccgacggcctcgagtactccaggaccggcctgcaagcgggcctgaccatcgacgagttcgccccccggctgtcttttttttggggaatcggcatgaacttctacatggagatcgccaagatgagggccggtcgccggctctgggcccacctgatcgagaagatgttccagcccaagaacagcaagagcctcctgctgagggcccactgccagaccagcggctggagcctgactgagcaagatccctacaacaacatcgtgcggacggccatcgaggcgatggctgccgtcttcggcggaacccagagcctgcataccaacagcttcgatgaagccctggggctgcccaccgtgaagtccgcgaggatcgccaggaacacgcagatcattatacaggaggagagcgggatccccaaggtggcagatccctggggcggaagctacatgatggagtgcctgaccaacgacgtgtacgacgcggcgctgaagctgattaacgagatcgaggaaatgggaggcatggccaaggccgtggccgagggcattcccaaactccggatcgaggagtgtgcagccaggcgacaagccaggatcgacagtggctccgaggttatcgtcggcgtgaacaagtaccagctggagaaagaggacgccgtggaggtcctggccatcgacaacacaagcgtgaggaaccggcaaatcgaaaagctgaagaagatcaaaagcagccgggaccaggccctcgccgagcgctgtctggccgccctcaccgagtgtgctgccagcggtgacggcaatatcctggccctggccgtggatgccagccgcgcccggtgcaccgtcggcgaaatcaccgatgccctgaagaaagtgttcggggagcacaaggccaacgaccgcatggtgtccggcgcctatcggcaggagttcggcgagagcaaggaaataaccagcgccatcaagcgggtgcacaaattcatggagcgggagggccggcggcccaggctgctggtcgccaagatgggccaggacgggcacgacaggggagctaaggtgatcgcgacggggttcgccgatctgggctttgacgtggatatcggacccctcttccagacaccgcgggaggtggcccagcaggccgtggacgccgacgtgcatgccgtcggcgtgagcacactggccgccggacacaagactctggtgcccgagctcatcaaggagctgaacagcctcggacggcccgatatcctcgtgatgtgcggtggcgtgatccccccgcaggactacgaatttctctttgaggtgggcgtgagcaacgtgttcggccccggcacgaggatccccaaagccgccgtgcaggtgctggacgacatcgagaagtgtttggagaagaagcagcagtccgtg

SEQ ID NO: 744 - DNA, 2250 bp, Artificial Sequence
  Codon optimized sequence that encodes an MCM polypeptide with the I671V mutation
atgctgagggccaagaaccagctgtttctcctgagcccccactacctcaggcaggtgaaggagagctccggctcaaggctgatccagcaacgtctgctgcatcagcagcaacccctgcacccagagtgggccgccctcgccaagaagcagctgaagggcaaaaaccccgaggatctgatctggcacacccccgagggcatcagcatcaagcccctgtactccaagagggatacaatggacctgccggaggagctgcccggagtgaaacccttcaccagaggcccctaccccaccatgtacacctttaggccctggaccatacggcagtacgccgggttcagcaccgtggaggagagcaataaattctacaaggacaacataaaggccggacagcagggcctgtccgtggccttcgacctggccacccacaggggctatgacagcgataacccccgcgtgaggggggacgtcggcatggccggagtagccatcgataccgtggaggataccaagatcctgttcgacggcatccccctcgagaagatgagcgtgtccatgaccatgaatggcgcagtgatccccgtgctggccaacttcatcgtgaccggtgaggagcagggcgtgcccaaggagaaactgaccgggaccatccagaacgacatactgaaggagtttatggtgcggaacacgtacatattcccccccgagcccagcatgaagatcatcgccgacatcttcgaatataccgccaagcacatgcccaagttcaacagcattagcatctcaggctaccacatgcaggaggccggcgccgacgcgatcctggagctggcctacaccctggccgacggcctggagtacagccggaccggcctgcaggcaggcctgaccatcgacgaattcgccccccggctctccttcttctgggggatcggcatgaacttttacatggagatcgccaaaatgcgggccggccggcggctctgggcccacctgatcgaaaagatgttccagcccaagaacagcaagagcctgctgctgagggcccactgccagacgagcggctggagcctgaccgagcaagacccctacaacaacatcgtgcgcaccgccatagaggccatggccgccgtgttcgggggtacacaaagcctccacactaacagcttcgacgaggccctgggtcttcccacggtgaagtcagcgcgcattgcccgcaacacccagatcatcatccaagaagagtccggcatccccaaggtggccgacccctggggcgggagctacatgatggaatgcctcaccaacgacgtgtatgacgcggcgctcaagctgatcaacgagatcgaagaaatgggcggcatggcaaaggccgtggccgagggcatccctaagctgagaatcgaggagtgcgcagccagacggcaggccaggattgacagcggcagcgaggtaatcgtgggagtgaacaagtatcagctggagaaggaggacgccgtggaagtgctggccatcgacaacacctccgtgaggaatcgacagatcgagaagctgaagaagatcaagtccagccgggaccaggccctggccgagaggtgcctggccgccctgaccgagtgtgccgccagcggggacggcaacatccttgccctggccgtggacgcgtccagggcccgctgtaccgtgggcgagatcaccgacgccctgaagaaggtgtttggggagcacaaggccaatgatcgcatggtgtccggcgcgtaccggcaggagttcggagagagcaaggagatcacctccgccattaagagggtgcacaagttcatggaaagggagggccggaggccccgcctactggtggccaaaatgggccaagacggccacgacaggggagccaaggtgatcgccaccgggttcgcggacctgggctttgacgtcgacatcggccccctgtttcagacccccagggaagtggcgcagcaggcggtggacgccgatgtgcacgccgtgggcgtgagcacactggcagccggccacaagactctggtgcccgagctgataaaagagctgaactctctgggcaggcccgacatcctggtgatgtgcggcggcgtcatccccccccaagactacgagttcctgttcgaggtgggcgtaagcaatgtgttcggccccggcacccgaattcccaaggcggccgtgcaagtgctggacgacatcgagaagtgcctcgagaagaagcagcagagcgtc

SEQ ID NO: 745 - DNA, 2250 bp, Artificial Sequence
  Codon optimized sequence that encodes an MCM polypeptide with the I671V mutation
atgctcagggccaagaatcagctgttcctgctcagcccccattacctgaggcaggtgaaggaatcgtccgggtcccgcctcatccagcagcgactcctgcaccagcagcagccactacaccccgagtgggccgccctggccaagaagcagctgaaaggcaagaaccccgaggatctcatctggcacacgcccgagggcatcagcatcaaacccctgtattccaagcgtgacaccatggacctgcccgaggagctgcctggtgtcaagcccttcacccgggggccctacccgacgatgtacacctttcgtccctggaccatcaggcagtacgccggcttcagcaccgtagaggagagcaacaagttctacaaagacaacatcaaagccggtcagcaagggctgtccgtggccttcgacctggccacgcaccgcggctatgacagcgacaacccccgagtcagaggggacgtggggatggccggggtggcaatcgataccgtcgaggacaccaagattctgttcgatggcattcccctggagaagatgagcgtcagcatgaccatgaatggagccgtgatccccgtgctggccaacttcatcgtgactggtgaggaacagggcgtgcccaaggagaagctgaccgggaccatccagaacgacatcctgaaggagtttatggttcgcaatacctacatattcccccccgagcccagcatgaagatcatcgccgatatcttcgaatataccgccaaacacatgcccaagtttaatagcatcagcatcagcggctaccacatgcaggaagccggggccgacgccatcctggagctggcatacactctggccgacggcctggagtacagccgcaccggcctccaagcagggctcacgatcgacgagttcgccccacggctcagcttcttctgggggatcggcatgaatttctacatggagatcgccaagatgagggccggtcggaggctttgggcccatttgatcgaaaaaatgttccaacccaagaatagcaaatccctgctgctcagggcccactgccagaccagcggctggtcactgaccgaacaggacccatacaacaatatcgtgaggaccgccatcgaggccatggcggcggtgttcggcggcacccagagcctccacaccaacagttttgacgaggccctgggactgccgaccgtgaagagcgcccggatcgcgcgcaacacgcagattatcattcaggaggagtccggcatccccaaggtcgccgacccctggggcggcagctacatgatggaatgcctgaccaacgacgtgtacgacgccgccctcaagctcatcaatgagatcgaggagatgggcgggatggccaaggccgtggccgagggcatccccaagctgcgaatcgaagaatgcgccgccaggcggcaggcccggatcgactccggctccgaggtcatcgtcggcgtcaacaagtaccagctcgagaaggaggatgccgtggaggtgctggccatcgataacacgtccgtgaggaaccggcagattgagaagctgaagaagatcaagagctcccgagaccaggccctggccgagaggtgcctggccgccctgactgagtgcgccgcctccggggacgggaacatcctggccttggctgtggacgcgagcagggccaggtgcaccgtgggcgaaatcaccgacgccctcaagaaggtcttcggcgagcacaaggccaatgaccggatggtcagcggtgcctacaggcaggagttcggtgaatccaaggagatcacctcggccataaaaagagtccacaagtttatggagagggaagggcgtaggccccgactcctggtggccaagatgggccaagacggccacgaccggggcgccaaggtcatcgccaccgggttcgccgacctggggttcgacgtcgacatcgggcccctgttccagaccccacgagaggtggcccagcaggccgtcgacgccgacgtgcacgccgtgggcgtctccacgctggcggccggccacaaaaccctcgtgcccgagctgatcaaggagctgaattccctcggccggcccgacatcctggtgatgtgcgggggggtcatccccccccaagattacgagttcctgttcgaggtgggcgtgagcaacgtgttcggccccggcaccaggatccccaaggccgccgtgcaggtgctggacgacatcgagaagtgcctcgagaagaagcagcagtccgtg

SEQ ID NO: 746 - DNA, 2250 bp, Artificial Sequence
  Codon optimized sequence that encodes an MCM polypeptide with the I671V mutation
atgctgagggccaagaaccagctattcctgctgagcccacactacctccggcaggtgaaggagagcagcggaagcaggctgatccagcagcggctgctccaccagcagcaaccactgcaccccgagtgggccgccctcgccaagaaacaactgaagggcaagaaccccgaagacctaatctggcacactccagagggtatcagcatcaagcccctgtactccaagagagacaccatggacctgcccgaggaactgcccggcgtcaagccctttaccaggggcccctaccccaccatgtataccttccgaccctggaccatcaggcagtacgccgggttcagcacggtggaggagtccaataagttctacaaggataacatcaaggccggtcagcagggtctgtccgtggccttcgacctggccacccaccgcggatatgacagcgacaacccgagggtgaggggcgacgtggggatggccggcgtggccatcgacaccgtggaggacacaaagatactgttcgacggaatcccgctggaaaagatgagcgtcagcatgaccatgaacggggccgtgatccccgtgctggccaacttcatcgttaccggtgaggaacagggggtgcctaaggagaagctgaccggcaccatacagaacgacatcctgaaggagtttatggtgaggaacacctatatcttcccccccgagccaagcatgaaaatcatcgcagacatctttgagtacaccgccaagcacatgcccaagttcaacagcatcagcatttccggctaccacatgcaggaagccggggccgacgccatcctcgaactggcctacaccctggctgacggcctggagtacagccggacagggctgcaggccgggcttacgatcgacgagttcgccccccggctgtccttcttttgggggatcgggatgaacttctatatggagatcgcaaagatgagggccggcaggaggctgtgggcgcacctcatcgagaagatgttccagccgaaaaactcgaagagcctgctgctgcgcgcccattgccaaacaagcggctggtcactgacagagcaggacccctacaacaatatcgtgaggaccgccatcgaggccatggccgccgtgttcgggggcacccagagcctgcatactaactccttcgacgaggccctgggtctccccacggtgaagagcgccaggatcgccaggaacacccagatcattatccaggaggagagcggcattcccaaggtggccgacccctgggggggctcctacatgatggagtgcctgacaaacgatgtgtacgacgccgccctcaagctgatcaacgagatcgaggagatggggggcatggccaaggccgtggccgagggcatccccaagctgcggatagaggagtgcgccgccaggcgccaggccaggatcgacagcggttccgaggtgatcgtgggcgtgaacaagtatcagctggagaaggaagacgccgtggaggtcctggccatcgacaacacatcggtgagaaataggcagatcgaaaagctcaaaaagatcaagtccagccgtgaccaagccctggccgagaggtgtctggcggccctgaccgagtgcgccgccagcggcgacggcaacatccttgccctcgcggtcgatgccagcagggccaggtgcaccgtgggggaaatcaccgacgccctgaagaaggtgttcggcgagcacaaagccaacgacaggatggtgagcggcgcctaccgccaagagttcggcgagtccaaggagatcaccagcgccatcaagcgcgtgcacaagttcatggagagggaaggcaggaggccgcgcctgctggtggccaagatgggccaggacggccacgataggggggccaaagtcatcgccaccggcttcgccgacctgggcttcgacgtggacatcggccccctgtttcagaccccccgtgaggtcgcccagcaggccgtggacgcggatgtgcacgccgtgggggtgtccaccctggccgccggacataaaaccctggtgccggaactgatcaaggaactgaacagcctgggacggcccgacatactggtgatgtgcggaggcgtgatccccccccaggattacgagttcctgttcgaggtgggcgtttccaatgtgttcggaccgggcacgcggattcccaaggccgcagtgcaggtgctggatgacatcgaaaaatgcctggagaagaagcagcagtcagta

SEQ ID NO: 747 - DNA, 2250 bp, Artificial Sequence
  Codon optimized sequence that encodes an MCM polypeptide with the I671V mutation
atgctgcgcgccaagaaccagctgttcctgctgtccccccactacctgcggcaggtgaaggagagctccggcagccgtctgatccaacagcggttactgcaccagcaacagcctctgcacccagagtgggccgccctggccaagaagcagctcaaagggaagaaccccgaggacctgatctggcacacccccgaaggcatcagcatcaagcctctctatagcaagcgagacaccatggaccttcccgaggagctgcccggcgtcaagcccttcacccgaggcccctaccccaccatgtataccttccgcccctggacaatcaggcaatacgccggcttcagcaccgtggaggagagcaacaagttctacaaggacaacatcaaggccggccagcaaggcctcagcgtggccttcgacctggcgacccacaggggctatgacagcgataaccccagggtcaggggggacgtgggcatggccggggtggccatcgacaccgtggaagacaccaagatcctgttcgacgggatccccctcgagaaaatgtcggtgtccatgaccatgaatggagccgtgatccccgtactggccaacttcatagtcaccggagaggagcaaggcgtcccaaaggagaagctgaccggcaccatccagaacgacatcctgaaagagtttatggttagaaacacctatatcttcccccccgagccctccatgaagatcatcgcggatatcttcgaatacaccgccaagcacatgcccaagttcaacagcataagcattagcggctaccatatgcaagaggccggcgccgatgccatcctggagctggcttacaccctcgccgatggcctggaatacagccgaaccggactgcaggccgggctcaccattgacgaatttgcaccccgtctaagcttcttctggggcatcggcatgaacttttacatggagatcgccaagatgcgcgccgggcgaaggctgtgggcccacctgatcgagaagatgttccagccgaagaacagcaagagcctcctgctgagggcccactgccagacctccggttggagcctgaccgagcaggacccctacaataacatcgtgcgcacggccatcgaggccatggccgccgtgttcggggggacccaaagcctgcacaccaactcgttcgacgaagcgctgggcctcccgacggtgaagtccgcccgcatcgcccggaacacccagatcatcatccaagaggagagcggcattcccaaggtggcagacccctggggcggtagctacatgatggagtgcctgaccaatgacgtctacgatgccgccctgaagctcatcaacgagatcgaggagatgggcggtatggccaaggccgtggccgaaggcatccccaagctgcgcattgaggaatgcgccgcccggaggcaagcccggatagacagcggctccgaagtgatcgtgggcgtcaacaaataccagctggagaaggaggacgccgtcgaggtgctggccattgacaacaccagcgtgaggaacaggcagatcgaaaagctgaaaaaaattaagagctcgagggatcaagccttggccgagaggtgtctggccgccctgaccgagtgcgccgccagcggcgatggcaacatcctggccctggccgtggacgccagccgcgcccggtgtaccgtgggcgagattaccgacgccctgaagaaggtctttggggagcacaaggccaacgaccgaatggtgagcggcgcctataggcaggagtttggcgaaagcaaggagatcaccagcgccatcaagcgtgtgcataagttcatggagcgggagggccggcgcccgaggctgctcgtcgccaagatgggccaggatggccatgacaggggcgccaaggtcatcgccaccgggtttgccgacctgggcttcgacgtggacatcgggcccctcttccagacgccgcgcgaagtcgcccagcaggccgtagatgccgacgtgcacgcagtgggcgtgtccaccctcgcagcggggcacaagacactggtgcccgagctgattaaggagctcaactccctgggccgacccgacatcctggtgatgtgcgggggcgtcatccccccccaggactatgagttcctgttcgaggtgggcgtctccaacgtgttcggccccggcactaggatccccaaggccgcagtacaggtgctcgacgacatagagaagtgcctggagaagaaacagcagagcgtg

SEQ ID NO: 748 - DNA, 2250 bp, Artificial Sequence
  Codon optimized sequence that encodes an MCM polypeptide with the I671V mutation
atgctgagggctaagaaccagctgttcctgctgagcccccactacctgaggcaagtgaaggagtcctcgggcagcaggctgatacagcagaggctgctgcaccaacaacagcccctgcaccccgagtgggccgccctggccaagaagcagctgaaggggaagaatccggaggacctgatctggcacaccccagagggcataagcatcaaacccctgtacagcaagcgggataccatggacctgcccgaggagctgcccggcgtgaagcccttcacgaggggcccctaccccaccatgtatacctttaggccctggaccatcaggcagtatgccggcttcagcaccgtggaggagagcaacaaattctacaaggataacataaaggccgggcagcaaggtctcagcgtcgccttcgatctcgccacccatcggggctacgactcggataacccccgcgtgcgcggcgacgtaggaatggccggcgtcgccatcgacaccgtggaggacacgaagatactattcgacggaatccccctggaaaagatgagcgttagcatgaccatgaacggggccgtgatccccgtgctggccaatttcatcgtgaccggcgaagagcagggcgtgccgaaggagaagctcaccggtaccatccagaacgacatcctgaaagagttcatggtgaggaatacctacatctttccccccgaacccagcatgaagatcattgcggacatcttcgagtataccgctaagcacatgccgaagtttaacagcatctccatcagcggctaccatatgcaagaggccggcgccgacgccatcctggagctggcgtacaccctcgccgacggcctcgagtatagccgtaccggcctgcaggcggggctcaccatcgacgagttcgccccccgactgagtttcttctggggcatcggcatgaacttctacatggagatcgcaaagatgagggccggccgaaggctctgggcccacctgatcgagaagatgtttcagcccaagaacagcaagagcctgctgctgagggcccactgccagacctccgggtggtccctgaccgagcaggacccctacaataatattgttagaaccgccatcgaggccatggccgcagtcttcggaggcacccagagcctgcacaccaactccttcgacgaggccctgggcctgccgaccgtgaagagcgccaggatcgccaggaacacccaaatcataatccaggaggagagcggcatccccaaggtcgccgacccctggggcggatcctacatgatggaatgcctgaccaacgacgtgtacgacgccgccctgaaactgatcaatgagatcgaggagatgggcgggatggcgaaggccgtggccgaggggatccccaagctgcggatcgaggagtgcgccgccaggaggcaggcccgcatcgacagcggcagcgaagtgatcgtgggcgtcaacaagtaccagctggagaaagaagacgccgtggaggtgctcgcaatcgacaacaccagcgtaaggaatcgccagatcgaaaagctgaaaaagatcaaaagcagccgagaccaggccctggccgagaggtgtctggccgccctgaccgagtgtgccgccagcggcgacgggaacattctggccctggccgtggatgcaagcagggctaggtgcaccgtgggcgagataaccgacgcgctgaagaaggtgttcggcgagcacaaggccaacgaccgcatggtgtcgggggcctatcggcaggagtttggggagagcaaggagattacctccgcgattaagagggtccacaagttcatggagcgcgaaggcaggcggccccggctgctggtggccaagatgggccaggacgggcacgatcgtggagccaaagtgatcgccaccggcttcgccgacctgggcttcgacgtggacatcggccccctcttccagacccccagggaggtggcccagcaggccgtggacgccgacgtccacgccgttggcgtgtccacactggccgccggacacaaaaccctggtgcccgagcttatcaaagagctgaacagcctgggcaggcccgacatactcgtgatgtgcgggggcgtgatccccccccaggactacgagttcctgttcgaagtgggcgtgagcaacgtctttggccccggcaccaggatccccaaggccgccgtgcaggtgctcgacgatatcgagaaatgccttgagaagaagcagcagagcgtg

SEQ ID NO: 749 - DNA, 2250 bp, Artificial Sequence
  Codon optimized sequence that encodes an MCM polypeptide with the I671V mutation
atgctgagggccaagaaccagctgttcctgctgagcccccactacctgaggcaggtgaaagaaagcagcggcagcaggctaatccaacagcgtctgctccaccagcagcagcccctccatccagagtgggcggccctggcgaaaaagcaactcaagggcaagaatcccgaagatctcatctggcatacgcccgaggggatcagcataaagccgctgtacagcaagagggacaccatggatctgcccgaggaactgcccggcgtgaagccctttacgcggggcccctacccgaccatgtacaccttccggccctggaccatccgacagtacgccgggttcagcaccgtggaggagagcaataagttttacaaggacaatatcaaagccggccagcagggcctgtccgtcgccttcgacctggccacccaccgcggatatgacagcgacaacccccgggtgcggggcgacgtgggcatggccggcgtggccatcgacaccgtggaggacacaaagatcctgttcgacgggatacccctggagaagatgagcgtcagcatgaccatgaacggcgccgtgatcccagtcctggccaacttcatcgtgaccggcgaggaacagggggtgcccaaggagaagctgaccggcaccatccagaatgatatcctgaaggagttcatggtgcggaacacctacatcttcccccccgaaccgagcatgaagatcatcgccgacatctttgagtacaccgccaagcatatgcccaagtttaatagcatcagcatcagcgggtaccacatgcaggaggccggagccgacgccatcctcgagctcgcctacactctcgccgacggcctcgagtacagccggaccggactgcaggccggcctcaccatcgacgagttcgcaccccggctgtccttcttctgggggatcggcatgaatttctacatggagatcgccaagatgcgggccggcaggcgcctgtgggcccacctcatcgagaagatgttccagcctaaaaacagcaagagcctgctgctgagggcgcactgccagacctccggctggagcctgaccgaacaggacccctataataatattgtccggaccgccatcgaagccatggcagccgtgttcggcggtacccagtccctgcacaccaactccttcgacgaggcgctgggcctgcccaccgtcaagtccgccaggattgcccgtaacacccagatcatcatacaggaggagtcaggcatcccgaaggtggccgacccctggggcggctcctacatgatggagtgcctcaccaacgacgtgtacgacgccgccctgaagctgatcaacgagatcgaggagatgggcggcatggcaaaggccgttgccgagggcatccccaagctgaggatcgaagagtgcgccgccaggaggcaggcccggatagactccggcagcgaggtgatcgtcggcgtgaacaagtaccagctggagaaggaagatgccgtggaagtgctggccatcgacaatacctccgtgcgcaaccgtcagatcgagaagctcaagaaaatcaagtccagccgggaccaggccctggcggaacgatgtctggccgccctgaccgagtgcgccgccagcggcgatggcaatatactggccctggccgtggacgccagccgcgcccggtgcaccgtcggggagatcaccgacgccctgaagaaggtgttcggggaacacaaggccaacgaccggatggtgagcggcgcctacaggcaggagttcggggagagcaaggagatcaccagcgccatcaagagggtccacaagttcatggagagggagggcaggcggccgcggctgttggtggccaaaatggggcaggacgggcacgaccggggcgccaaggtcatcgccaccggcttcgccgatctgggttttgacgtggacatcggccccctgttccaaacccccagggaggtggcccagcaggccgtcgacgccgacgtgcatgccgtcggcgtgtccaccctggccgccgggcacaagacactggtccccgagctcatcaaggagctcaattccctgggcaggcccgacatcttggtcatgtgcggcggcgtgatccccccgcaggactatgagttcctcttcgaggttggggtgagcaacgtctttggccctgggacaaggatccccaaggccgccgtgcaggtgctggacgacatcgagaaatgtctcgagaagaagcaacagagcgtt

SEQ ID NO: 750 - DNA, 2250 bp, Artificial Sequence
  Codon optimized sequence that encodes an MCM polypeptide with the I671V mutation
atgctcagggccaagaaccagctcttcctgctctccccccactacctgaggcaggtgaaggaatcctccgggagcaggctgatacagcagaggctgctgcaccaacaacagcccctccaccccgagtgggccgccctggccaagaagcagctgaaagggaagaaccccgaagacctcatctggcacacccccgaagggatcagcatcaagccgctgtacagcaagcgggacacgatggacctgcccgaggagctgcccggggtcaaaccattcaccagggggccctaccccaccatgtataccttccgcccctggacgatcaggcagtacgccggcttttccacggtggaggagagcaacaagttctacaaggataacatcaaggccggacagcagggcctgagcgtcgccttcgacctggccacccataggggctacgacagcgacaaccccagggtacgtggcgacgtaggaatggccggggtcgccatcgacaccgtggaagacaccaagatcctgttcgacgggatccccctcgagaaaatgagcgtcagcatgaccatgaacggggccgtcatccccgtgctggccaacttcatcgtgacgggcgaggagcaaggagtacccaaagaaaagctgaccggcaccatccagaacgacatcctgaaggagttcatggtccggaacacctacatcttccccccggaaccaagcatgaagatcatcgccgatatcttcgagtacaccgccaaacacatgcccaagttcaattccatcagcatcagcggctaccacatgcaggaggccggcgcggacgccatcctggagctcgcctacaccctggcggacggcctcgagtacagcaggaccggcctgcaggcaggactgaccatcgacgagttcgcccccaggctgtccttcttctggggcatcggcatgaacttctacatggagatcgccaagatgcgggccggcaggcggctgtgggcccacctgatcgagaagatgttccagcccaagaacagcaagtcgctgctgctgcgcgcgcattgtcagaccagcggctggtcactcaccgagcaggatccgtacaacaatatcgtgcgaaccgccatcgaggccatggccgcagtgttcggcggcacccagagcctgcacaccaatagcttcgacgaggcgctggggctgcccaccgtgaagagcgcccggatcgcccgaaacacacagatcatcatccaggaggaaagcggcatccccaaggtggccgacccctgggggggcagctacatgatggagtgcctgaccaacgatgtgtacgacgccgccctgaagctgatcaacgagatcgaggagatggggggcatggccaaagccgtggcggaggggattcccaagctgaggatagaagagtgcgctgccaggcgccaagcccggatcgacagcggctcggaggtcatcgtgggcgtgaacaagtaccagctggagaaggaggacgcagtggaggtcctggctatcgacaacacgagcgtgaggaaccggcaaatcgaaaaactgaagaagataaagagcagccgcgaccaggcgctggccgagaggtgcctggccgccctgaccgagtgtgcggcctccggcgatggcaacatcctggccctcgccgtggacgcctccagagccaggtgcaccgtgggggagatcaccgacgccctcaagaaggtgttcggggagcataaggccaatgacaggatggtcagtggggcctaccgccaggagttcggcgagtccaaggagataaccagcgccatcaagagggttcacaagttcatggagagggaaggcagacgccccaggctgctggtcgccaagatgggccaggacggccacgaccgaggtgccaaggtgatcgccaccggcttcgcggacctgggcttcgatgtcgacatcggccccctgttccagaccccccgcgaggtcgcccagcaagccgtcgacgccgacgtgcacgccgtaggggtgagcaccctcgccgcgggccacaaaaccctggtgcctgagctcatcaaagaactcaactccctgggaaggcccgacatactggtgatgtgcggcggcgtgatccccccacaggactacgagttcctcttcgaggtgggcgtgtccaacgtgttcgggcccgggacccggatccccaaggccgccgtccaagtgctggacgacattgagaaatgcctggagaagaagcagcagagcgtg

SEQ ID NO: 751 - DNA, 2250 bp, Artificial Sequence
  Codon optimized sequence that encodes an MCM polypeptide with the I671V mutation
atgctgagggccaagaaccaactgttcctgctgtccccccactacctcaggcaggtcaaggagtcgagcggcagcaggctgattcagcaacggctgctgcaccaacaacagcccctgcaccccgagtgggcggcgctggcgaagaagcagctgaaggggaaaaaccccgaggacctgatctggcacacccccgagggcatcagcataaagcccctgtatagcaaacgcgacaccatggacctcccagaggagctgcccggcgtgaagccgtttacccgcgggccctaccccaccatgtacaccttcaggccctggaccatccgacagtacgccggtttcagcaccgtcgaggagtcaaacaagttctacaaggacaatatcaaggccggccagcaaggtctgagcgtggccttcgacctggcgacccacaggggctacgattccgataatccgagggtgaggggtgatgtgggcatggccggcgtggccatcgacaccgttgaggatacaaaaatcctgttcgacggcatccccctggagaagatgtccgtgagcatgaccatgaacggcgccgtcatccccgtgctggccaacttcatcgtgacaggcgaggagcaaggcgtgcccaaagagaagctcaccgggaccatccagaacgacatcctgaaagagttcatggtgcggaacacctacatattcccacccgagcccagcatgaagatcatcgccgacatcttcgagtataccgccaagcacatgcccaagttcaactccattagcatctccggctatcacatgcaggaggccggcgccgacgccatcctggagctggcctacaccttagccgacggcctggagtactccaggaccggcctccaggccgggctgaccatagatgagttcgcaccccggctgtccttcttctggggcataggcatgaacttctacatggagatcgccaagatgagggccgggcggagactgtgggcccatctgatagaaaagatgttccagcccaagaacagcaagagcctcctgctaagggcgcattgccaaacctccggttggagcctcaccgaacaggacccctacaacaatatagtgaggaccgccatcgaagccatggccgccgtgtttggcggcacccaatccctccacaccaacagcttcgatgaggccctggggctgcccactgtaaagagcgcccgcatcgcacgcaacacccagatcatcatccaggaggaaagcggcattcccaaagtcgccgacccgtggggggggtcctacatgatggagtgcctgaccaacgacgtgtatgacgccgccctgaagctgatcaacgagatagaagagatgggtggcatggcaaaggctgtcgccgagggcatcccgaagctgcggatcgaagagtgcgccgccaggaggcaagcccggatagactccggcagcgaggtgatcgtgggtgtgaacaagtaccagctggagaaggaggacgccgtcgaggtgctggccatcgacaacaccagcgtgaggaacaggcagatcgagaaactcaagaagatcaagagcagccgcgaccaagccctggccgagcggtgtctggccgccctgaccgagtgcgccgcttccggcgacggaaacatcctggccctggccgtcgacgccagccgggcccggtgcaccgtcggcgagatcaccgatgccctgaagaaggtcttcggggagcacaaggccaatgaccggatggtgagtggcgcttacaggcaggagttcggcgagagcaaggaaatcacgagcgccatcaagagggtccacaagttcatggagcgggaggggaggaggcccaggctgctggtggccaagatgggccaggacgggcacgacaggggcgcgaaggtcatcgccacgggcttcgccgacctggggtttgatgtcgacatcggcccactcttccagaccccccgggaggtggcccaacaggccgtcgacgccgacgtccacgccgtgggggtgagcaccctggccgccgggcacaagaccctggtgcctgaactgatcaaggagctgaacagcctgggcaggccagacatactggttatgtgcgggggtgtgatacccccgcaggactacgagttcctctttgaggtgggcgtgagcaacgtgtttggccccggcaccaggatccccaaagccgccgtgcaggtgctggatgatatcgaaaagtgcctggagaaaaagcaacagtccgtg

SEQ ID NO: 752 - DNA, 2250 bp, Artificial Sequence
  Codon optimized sequence that encodes an MCM polypeptide with the I671V mutation
atgctgcgggccaagaaccagctgttcctgcttagtccccactacctccgtcaagtgaaggagtcctccgggagccggctcatacagcagaggctgctccaccagcagcagcccctgcatcccgagtgggccgccctggccaagaagcagctgaagggtaaaaaccccgaggatctgatctggcacacccccgagggcatcagcatcaagcccctctacagcaagcgcgataccatggacctccccgaggagctccccggcgtgaagcccttcacaaggggcccctaccccaccatgtacacctttaggccgtggaccatccggcagtatgccggcttcagcaccgtggaggaatccaacaagttctacaaagacaacatcaaggcggggcaacagggcctgagcgtggccttcgacctggccacccatagggggtacgactccgacaacccgagggtgagaggcgacgtcgggatggccggcgtggccattgacacagtggaggataccaaaatcctgttcgacgggatacccctggaaaagatgtcggtgtccatgaccatgaacggcgccgtaatccccgtgctggcgaacttcatcgtgaccggcgaggaacagggcgtgccaaaggaaaagctgacggggacgatccagaacgacattctcaaggaattcatggtgaggaacacctacatctttccccccgagcccagcatgaaaatcatcgcagacatctttgaatacaccgccaagcacatgcccaagttcaacagcatcagcatctccggctaccacatgcaggaggccggcgccgacgccatactggaactggcatacaccctggccgacgggctcgagtactccaggaccgggctccaggccggactgaccatagacgaattcgccccacggctgtccttcttttggggcatcgggatgaacttctacatggagatcgccaagatgcgagccggccgcaggctgtgggcccacctgatagagaagatgttccagcccaagaactccaagtcactgctgctgagggcccattgccagaccagcggctggagcctcaccgagcaggacccctacaacaacatcgtcaggaccgccatcgaggccatggccgccgtcttcggcggcacccagtccctgcataccaactcctttgatgaggcgctgggcctgcccacagtgaagagcgccaggatcgccaggaatacacagatcatcatacaggaggagagcggcatcccgaaggtggcggacccctgggggggctcgtatatgatggagtgcctgaccaacgacgtgtacgatgccgccctgaagctgatcaacgagatcgaagaaatgggcggcatggccaaggccgtggccgaaggcatccccaagctgcgcatcgaggaatgcgccgcccgcaggcaggccaggatcgattccggcagcgaggtgatcgtcggcgtgaacaagtaccagctggagaaagaggacgccgtggaggtgctcgccattgacaacacctctgtgaggaatcgccagatcgagaaactcaagaagatcaagagctccagggaccaggcgctggccgagcggtgcctggccgcgctgaccgaatgcgccgcctccggggacgggaacatcctggcactcgcggtggacgcctccagggccaggtgcacggtgggcgagatcaccgacgccctgaagaaggtgtttggcgagcacaaggccaatgaccggatggtgtccggcgcctataggcaagagttcggggagagcaaagaaataaccagcgccatcaagcgggtgcacaagtttatggagagggaaggccgccgcccccggctgctggtcgccaagatggggcaggacggccacgaccgcggcgccaaggtgatagcgaccggcttcgccgatctgggcttcgacgtggatatcggccccctcttccagacgccccgggaggtggcgcaacaggcagtggacgccgacgtgcatgccgtgggcgtgtccaccctggccgcaggccacaagaccctggtgcccgagctgatcaaggagctgaacagcctgggtagacccgacatcctggttatgtgtggtggcgtcatccccccccaggactacgaatttctgttcgaggtcggtgtaagcaacgtgttcggccccggcacccggatccccaaggccgccgtgcaggtgctggacgacatcgagaagtgtctggagaagaaacagcagagcgtg

SEQ ID NO: 753 - DNA, 2250 bp, Artificial Sequence
  Codon optimized sequence that encodes an MCM polypeptide with the I671V mutation
atgctgcgagccaagaaccagctgttcctcctgagcccccactacctccggcaggtcaaggaaagctccggttcccggctgatacagcagaggctgctgcaccagcaacaacccctgcaccccgagtgggccgcacttgccaaaaaacagctgaaggggaagaaccccgaggacctgatctggcatacacccgagggcatcagcatcaagcccctgtactcgaaacgtgacaccatggacctgcccgaggagctgcccggcgtgaagcccttcaccagggggccctaccccaccatgtacaccttccgaccctggaccatccggcagtacgccggcttcagcacggttgaggagtcgaacaaattctataaggacaatatcaaagccggccaacagggcctgagcgtggcatttgatctggccacgcaccggggatacgatagtgataacccccgggtcaggggggacgtgggcatggccggcgtagccatcgacacggtggaggacaccaagatactgttcgacggcatcccactggaaaagatgtccgtgagcatgacgatgaacggggccgtgatcccggtcctggccaacttcatcgtgaccggcgaagagcagggggttcccaaggagaagctcaccggcaccatccaaaacgacatcctgaaggagttcatggtgcgcaatacctacatctttcccccggagcccagcatgaagataatagccgacatattcgaatacaccgccaagcacatgcccaagttcaatagcatctccatcagcggataccacatgcaggaagccggcgccgatgccatcctggaactggcctacaccctggctgatggactcgagtacagccggaccgggctgcaagccgggctgaccatcgacgagttcgcccccaggctgagctttttctgggggatcggcatgaatttttacatggagatcgccaagatgcgggccggcaggaggctgtgggcccacctgattgagaaaatgtttcaacccaagaactccaagagcctgctgctgagggcacactgtcaaaccagcgggtggagcctgaccgagcaggacccctacaacaacatcgtaaggacggccatcgaggccatggccgccgtgttcggtggcacccagagcctgcacaccaacagcttcgacgaggccctcgggctgcccaccgtgaagagcgcccgcatcgcccggaatacccagattatcatacaagaggagagcgggatcccgaaggtggccgatccgtggggcggctcctacatgatggagtgcctgaccaacgacgtctacgacgcggcgctgaagctgatcaacgagatcgaggagatgggcgggatggccaaagccgtggccgagggcatccccaagctgcggatcgaggagtgcgccgccaggaggcaggccaggatcgacagcggcagcgaggttatcgtgggggtcaacaagtaccaactggagaaagaagacgccgtggaggtgctcgccatcgacaacaccagcgtgaggaaccggcagattgagaaactgaagaaaatcaagagctccagggaccaggccctggccgagaggtgtctggccgccctgaccgaatgcgcggccagcggcgacggcaacatcctggccttggccgtggatgccagccgagccaggtgcaccgtgggagaaatcaccgacgccctgaagaaggtgttcggcgagcataaggccaatgacaggatggtgtccggcgcctaccgccaggagttcggtgagtcgaaagagatcaccagcgccatcaagcgcgtgcacaagttcatggagagggaaggcaggcggccgcggctgctcgtggccaagatgggccaagatggccacgaccgcggtgccaaagtcatcgccaccgggttcgcggatctgggcttcgacgttgacatcggccccctgttccagaccccccgggaggtggcccagcaggccgtggatgccgacgtgcacgccgtgggcgtgtccaccctggccgccgggcacaaaaccctggtgcccgagctgataaaggagctgaactccctgggaaggcccgatatcctggtcatgtgcggcggcgtgatccccccgcaggattacgagttcctattcgaagtaggcgtgagcaacgtgttcggcccggggaccaggatccccaaggcggccgtgcaggtcctggacgacatcgagaagtgcctggagaagaagcagcaatccgtc

SEQ ID NO: 754 - DNA, 2250 bp, Artificial Sequence
  Codon optimized sequence that encodes an MCM polypeptide with the I671V mutation
atgctgagggccaaaaatcagctgttcctgctgagcccccactacctccggcaggtgaaggaatcctcggggtccaggctgatccagcagaggctgctgcaccagcagcagcccctgcatccggagtgggccgccctggccaagaagcagctcaagggcaagaaccccgaggacctgatctggcacaccccagaaggcatctcgatcaaacccttgtactccaagagggacaccatggacctacccgaggagctgcccggggtgaagcccttcacccgcggcccctatcccacgatgtacacgttcaggccctggaccatccgccagtacgcgggcttcagcaccgtggaggagagcaacaagttttataaagacaacatcaaggccggccagcagggcctgagcgtggccttcgacctcgccacccaccgcggctacgacagcgacaacccccgcgtgaggggcgacgtggggatggccggcgtggcgatcgacaccgtggaggacacgaagatcctgttcgacgggatccccctggagaagatgagcgtctccatgaccatgaatggcgccgtgatcccagtgctggccaacttcatcgtgaccggcgaggagcagggggtcccgaaagagaaactcaccggcaccatccagaacgacatcctgaaggagttcatggtgaggaacacctacatcttccccccggaacccagcatgaaaatcatagccgacatcttcgagtacaccgccaagcatatgcccaaattcaacagcatcagcatatccggctaccacatgcaggaggccggcgccgacgcgatcctggaactggcctacaccctggccgacggtctggagtacagcaggaccggcctgcaggcgggtctcaccattgacgagttcgcgccgaggctgtccttcttctggggcatcggcatgaacttctatatggagatagccaagatgagggccggcagaaggctgtgggcccatctgatcgagaaaatgttccagccgaagaatagcaagtccctgctgctgagggcccactgtcagaccagcgggtggtccctaaccgagcaggacccctacaacaacatcgtgcggaccgcgatcgaagccatggcggccgtgttcgggggcacccagagcctgcacacgaacagcttcgacgaggccctaggcctgccaacggtgaagtccgccaggatcgcgaggaacacgcagatcatcatccaagaggaaagcgggatccccaaagtggccgacccctggggcggtagctacatgatggagtgcctcaccaacgatgtgtacgacgcggccctgaaactcattaatgagatcgaagagatgggcggcatggccaaagccgtggccgagggcatccccaagctgagaatcgaagagtgcgccgctaggcggcaagcccggatcgacagcggcagcgaggtgatagtgggcgtcaacaagtaccaactggagaaggaagacgccgtggaggtgctggcgatcgacaacacttcggtgcggaatcgtcagatagagaagctgaagaagatcaagtccagccgagaccaggccctggccgagaggtgcctggccgccctgacagagtgcgccgcctccggcgacggcaacatcctcgctctcgccgtagatgccagcagggcgcgctgtaccgtgggcgagatcaccgacgccctgaaaaaggtgttcggggaacacaaggccaacgaccggatggtgtctggcgcctaccgccaggagttcggggagtccaaggagatcaccagcgccatcaagcgcgtacacaagttcatggagagggagggcaggcgccccaggctgctcgtggccaaaatgggacaggacgggcacgacaggggcgccaaggtgatcgcgaccggattcgcggacctgggcttcgacgtggacataggacccctgttccagacccccagggaggtcgcccagcaggccgtggatgcggacgtgcatgccgtgggcgtctccaccctggccgccggtcacaagaccctggtgcccgagctgataaaggagctgaacagcctggggaggcccgacatcctggtgatgtgcggcggcgtgatccccccccaggattacgagttcctgttcgaagtgggtgtatccaacgtgttcggacccggcacccgcatcccgaaggccgccgtgcaggtcctggatgacattgagaagtgcctggagaagaagcagcagagcgtg

SEQ ID NO: 755 - DNA, 2250 bp, Artificial Sequence
  Codon optimized sequence that encodes an MCM polypeptide with the I671V mutation
atgctgagggccaagaaccagctgttcctgctgagcccccactatctgcgccaggtaaaggagagcagcgggtccaggctgatccagcagaggctgctgcaccagcagcagcccctccaccccgagtgggccgccctcgccaaaaagcagctcaaggggaagaaccccgaagacctgatatggcacacccccgaggggatctccatcaaacccctctattccaagagggacaccatggatctgccggaggagctgcccggagtgaagccctttacaaggggcccctaccccaccatgtataccttccggccctggaccatccgtcagtacgccggcttctcgaccgtcgaggagagcaacaagttctacaaggacaacatcaaggccgggcagcagggactcagcgtggcgtttgacctggccacacataggggctacgactccgacaatccccgggtgaggggcgatgtggggatggccggcgtggccatcgacaccgtcgaggacaccaaaatcctgtttgacggcatccccctggaaaagatgagcgtgtccatgaccatgaacggcgccgtgatccccgtgctagccaacttcatcgtgaccggcgaggaacaaggcgtgcccaaggagaagctcaccggcaccatccagaacgacatcctcaaggagttcatggtccgtaatacctacattttcccccccgaacccagcatgaaaatcatcgccgacatcttcgagtacacggccaaacacatgcccaagttcaactccatcagcatcagcggctaccacatgcaggaggccggggccgacgccatcctggagctggcctacaccctggccgacgggctggagtacagcaggaccggtctccaggccgggctgaccatcgacgagtttgccccaaggctgagctttttctggggcatcggcatgaacttttacatggagatcgcgaagatgcgcgccgggcgtcggctgtgggcccacctgatcgagaagatgtttcagcccaagaactcgaaaagcctgcttctgcgggcccactgtcagaccagcggctggtccctgaccgagcaggacccctacaataacatcgtgagaaccgcgatcgaggccatggcggccgtcttcggcgggacccaaagcctgcacactaacagcttcgacgaggccctgggtctccccaccgtgaagagcgccaggatcgcacgtaacacgcagatcatcatccaggaggagagcgggatccccaaggtggccgacccctggggcgggagctacatgatggagtgcctgaccaatgacgtgtacgacgctgctctgaagctgatcaacgagatagaggagatggggggcatggccaaggccgtcgccgagggcatccccaagctgaggatcgaggaatgtgccgccaggcggcaagcccggatcgacagcggcagcgaagtgatcgtcggcgtgaataagtaccagctggagaaagaggacgccgtggaagtgctcgccatcgacaacacctcagtccgtaacaggcagatagagaaactgaagaagataaagagctcccgcgaccaggccctggccgagcgttgcctggccgccctgactgagtgcgccgccagcggcgacggtaacatactagctctggcggtggacgccagccgggcgaggtgcaccgtcggggaaatcaccgacgcgctgaagaaagtgttcggagagcacaaggccaacgataggatggtgagcggggcctatcggcaagagttcggagaaagcaaggaaatcaccagcgccatcaagcgcgtgcacaagttcatggagagggagggcaggaggccgagactgctggtggccaagatgggccaggacggccacgaccgcggcgccaaggtcattgccaccggcttcgccgacctcgggtttgacgtggacatcggccccctgttccagacgccccgggaagtggcccagcaggccgtggacgccgatgtgcacgccgtgggcgtgtcgaccctggccgccggccacaagaccctggtgcccgagctgatcaaggagctgaacagcctgggtaggccagacattctggtgatgtgcggtggagtcattcccccccaggactacgagttcctgttcgaggtcggggtgagcaacgtgttcggccccggaacccgcatccccaaagccgccgtgcaggtgctggacgacatagagaagtgtctggaaaagaaacagcaaagcgtg

SEQ ID NO: 756 - DNA, 2250 bp, Artificial Sequence
  Codon optimized sequence that encodes an MCM polypeptide with the I671V mutation
atgcttagggccaagaaccagctgttcctcctctccccccactatctcagacaggtgaaggagagcagcggcagcaggctgatccaacagaggctcctccaccagcagcagcccctccacccggagtgggcagccctggctaagaaacagctgaaagggaagaatcccgaggatctgatctggcacaccccggaggggatatccataaagcccctgtattcgaagagggacaccatggacctgcccgaggagctgcccggcgtgaagccctttacccgcggaccctaccccaccatgtataccttcaggccctggaccatccggcagtacgccggtttctctaccgtggaggagtccaacaagttctacaaggacaacatcaaggccggtcagcagggcctcagcgtggccttcgatctggccacccaccggggctatgattccgacaacccgagggtccgcggcgacgtggggatggccggcgtggcaattgataccgtggaagacaccaagatcctgtttgacggcatccccctggagaagatgagcgtgagcatgaccatgaacggcgcagtgatccccgtgctggcaaatttcatcgtcaccggggaggagcagggcgtgccaaaggagaagctgaccggcaccatccagaatgatatcctgaaggagttcatggtcaggaatacctacatcttcccacccgagcccagcatgaaaatcatcgcggacatcttcgagtacaccgccaagcacatgcccaagttcaattccatcagcatctccgggtaccacatgcaggaggccggcgccgacgccatcctggagctcgcctacaccctggccgacgggctggagtatagccggacgggcctccaggccgggctcaccatagacgagttcgccccgaggctgagcttcttctggggcatcgggatgaacttctatatggaaatcgccaaaatgcgcgcggggcgccgtctttgggcccacctgattgagaagatgttccagccgaagaacagcaagtccctgctgctgcgcgcccattgccagacctccgggtggagcctcaccgaacaggacccctacaataacatcgtcaggaccgccatcgaggccatggccgccgtgttcggcgggacccagtccctccacaccaacagcttcgacgaggcactgggtctccccacagtgaaaagcgccaggatcgccaggaacacccaaatcatcatccaggaagaaagcggcatcccgaaggtggccgacccctggggcggcagctacatgatggagtgcctgaccaacgatgtgtacgatgccgccctgaagctcatcaacgagatcgaggagatggggggcatggccaaagccgttgccgaaggaataccaaagctgcgtatcgaggagtgcgccgcgaggaggcaggcgcgcatcgacagcgggtccgaggttatcgtgggcgttaacaagtatcagctggagaaggaggacgccgtggaggtgctggccatcgacaacacctccgtgaggaacaggcagatagagaagctgaagaaaatcaagagctccagggaccaagcgctggccgagaggtgcctcgccgcgctgacggagtgcgccgccagcggcgatggcaacatcctggccctggccgtggacgccagcagggcccggtgtacagtgggcgagatcaccgacgccctcaagaaggtgtttggggagcacaaggcgaacgacaggatggtgtccggcgcctaccggcaggagtttggcgagtcaaaagaaataacctccgccatcaagcgggtgcacaagttcatggagagggaggggaggaggcctaggctgctggtggccaagatgggccaggatggccacgacaggggcgccaaagtaatcgccacgggcttcgccgacctcgggttcgacgtggacataggacccctgttccagaccccccgggaggtggcccagcaggccgtcgacgccgacgtacatgccgtcggcgtgtccaccctggccgcaggccacaagaccctggtgcccgagctgatcaaggagctcaacagcctgggcaggcccgacattctcgtcatgtgcggcggtgtgatccccccccaggactacgagtttctgttcgaggtgggcgtcagcaacgtattcgggcccggcacgaggatccccaaggctgccgtgcaagtgctggacgacattgagaaatgcctggagaagaagcagcagtccgtg

SEQ ID NO: 757 - DNA, 2250 bp, Artificial Sequence
  Codon optimized sequence that encodes an MCM polypeptide with the I671V mutation
atgctgcgcgccaagaaccagttgttcctcctgagcccccactacctacggcaggtcaaagagtccagcggcagccggctcatccagcaaaggctgctgcatcagcagcagcccctgcaccccgagtgggccgcccttgccaagaaacagctgaagggcaaaaaccccgaagacctgatctggcacacccccgaaggcatcagcatcaagcccctgtacagcaagcgcgacaccatggacctgcccgaggaactgcccggcgtgaaacctttcacgaggggcccgtaccccaccatgtataccttccgcccgtggacgatcaggcagtatgctggcttcagcaccgtggaggagagcaacaagttttacaaagacaacatcaaggccgggcagcaggggctgagcgtcgccttcgacctcgccacccaccgcggctatgacagcgataatccccgggtgaggggggacgtgggcatggccggcgtcgcgatcgacacggtggaggacaccaagatcctcttcgacgggatccccctggagaagatgagcgtgagcatgactatgaacggcgccgtgatccccgtgctcgccaatttcatcgtgacgggcgaggagcaaggcgtgccgaaagagaagctgaccggcacgatccagaacgatatcctgaaggagtttatggtgaggaacacctacatcttccccccggagcccagcatgaagatcatcgcggacatcttcgaatacaccgcgaaacacatgcccaagtttaatagcatcagcatttccggctaccacatgcaggaggccggcgccgatgccatcctcgaactggcctacaccctcgccgacggtctggagtactccaggacagggctccaggccggactgaccatcgacgagttcgcccccaggctgagtttcttttggggcatcggcatgaacttctacatggagatcgccaaaatgagggccggcaggaggctgtgggcgcacctgatcgaaaagatgttccaaccgaagaatagcaaaagtctgctgctccgcgcccattgccagacatccggctggagcctgaccgagcaggatccctacaacaacatcgtgagaaccgccatcgaggccatggccgccgtgttcggcggcacccagtccctgcacactaacagcttcgacgaagccctgggcctccccaccgtgaaaagcgccaggatcgcccggaacacccagatcataatccaagaggagtctggcatcccgaaggtggcggacccgtggggcggctcctatatgatggagtgcctgaccaacgacgtgtacgacgccgccctgaaactcatcaacgagatagaagaaatgggcggcatggcgaaggccgtcgccgagggcatccccaagctgaggatcgaagagtgcgccgccaggaggcaggccaggatcgatagcggctccgaggtgatcgtgggcgtgaataagtaccaactggagaaggaggacgccgtggaggtgctggccattgacaacacctccgtcaggaacaggcagatcgagaaactgaagaagatcaagagctcacgggaccaggcgctggccgaacgatgcctggccgccctgaccgaatgcgcggccagcggggacggcaacatcctggccctggccgtggatgcgtccagggcgaggtgtaccgtgggcgagatcaccgacgccctcaagaaggtgttcggcgagcacaaggccaacgaccggatggtctccggcgcctacaggcaagagttcggggagtccaaggagattaccagcgccatcaagagggtccacaagttcatggagagggagggcaggcgcccccggctcctagtggccaagatgggccaggacggccacgacaggggggccaaggtgatcgcgacgggatttgccgatctgggcttcgacgtggacatcggccccctgttccagacgcccagggaggtggcccaacaggccgtggacgccgacgtgcacgccgtgggcgtctccactctggctgccggccataagaccctggtgcccgaactcattaaggaactgaatagcctcgggcgtcccgacatactggtgatgtgcggcggggtgatccccccacaggactacgaattcctgttcgaggtgggggtctccaacgtgttcggccccggtacccggatccccaaggcagccgtgcaggtactcgacgacatcgagaagtgtctggagaagaagcagcagagcgta

SEQ ID NO: 758 - DNA, 2250 bp, Artificial Sequence
  Codon optimized sequence that encodes an MCM polypeptide with the I671V mutation
atgctaagagcgaagaatcagctgttcctcctgagcccccattacctgagacaggtgaaggaatccagcggctcccgcctgatacagcagaggctgctccaccagcagcagcccctgcaccccgagtgggccgccctggccaaaaagcagctcaagggcaaaaaccccgaagacctgatctggcacaccccagaggggatctccatcaaaccgctgtacagcaagagggacaccatggacctgcccgaggaactgcccggggtgaagccgttcaccaggggcccctaccccaccatgtatacgttcaggccctggaccatcaggcagtacgccggattcagcacggtggaggaaagcaacaagttctacaaggataacataaaggccgggcagcagggcctgagcgtggccttcgacctggccacccaccgaggctacgacagcgataaccccagggtgcggggcgatgtcggaatggccggcgtggccatcgacacggtcgaggacaccaagatcctcttcgacgggatccccctcgagaaaatgtccgtgtccatgaccatgaacggcgccgtgatccccgtgctggccaatttcatcgtgaccggggaggagcagggcgtgcccaaggagaagctgaccggcaccatccagaacgacatcttgaaggaattcatggtgcgaaacacctacatcttcccccccgagccaagcatgaagatcatcgcggacatcttcgaatacaccgccaagcacatgcccaaatttaatagcatctccatctccggctatcacatgcaggaggccggtgccgacgcgatcctggagctggcctataccctcgccgacggtctggagtacagccggaccggcctccaggccggcctcaccatcgacgaattcgccccgcggctgagcttcttctggggcatcggcatgaacttctacatggagatcgccaagatgagggccggccgcaggctgtgggctcatctcatcgagaagatgttccagcccaagaactcgaagagcctgctcctgagggcccattgccagaccagcgggtggtccctgaccgagcaggatccctataacaatatcgtgcgtaccgccatcgaagccatggcagccgtgttcggcggcacccagagcctccacaccaacagcttcgacgaagccctgggcctgcccactgtgaagtccgccaggatcgcccggaacacccagatcatcatccaagaggagagcgggatccccaaggtggccgacccctgggggggcagctacatgatggagtgcctgaccaacgacgtgtatgacgccgccctcaagctcatcaacgagatcgaagagatgggcggcatggctaaggccgttgccgagggcatccccaagctgaggatcgaggagtgcgcagcccggaggcaggccaggatcgatagcggctcggaagtgatcgtgggggtgaacaagtaccagcttgagaaggaggacgccgtggaggtgctggccatcgacaatacctccgtgagaaacaggcagatcgaaaagctgaagaaaatcaagagctccagggaccaggcgctcgcggagcgatgcctcgccgccctgaccgagtgtgccgcctcgggtgacgggaacatcctggccctcgccgtcgacgcctccagggcccggtgcaccgtgggcgagatcaccgacgccctgaagaaggtgttcggcgagcataaagccaacgacaggatggtgagcggcgcctacaggcaggagtttggcgagagcaaggagatcaccagcgctatcaagagggtgcacaagttcatggaaagggaggggaggaggccccgcctgctggtcgccaagatgggccaagacgggcacgataggggcgccaaggtgatcgcgaccggcttcgccgacctgggatttgacgtggacatcgggccactgttccagacgccccgggaggtcgcccagcaggccgtcgacgccgacgtgcacgcggtgggcgtgagcacactggcagccggccacaaaaccctggtgccggagctgatcaaagagctgaacagcctgggaaggcccgacatcctggtcatgtgcggcggagttatccccccccaggactacgaattcctgttcgaggtgggcgtcagcaacgtgttcgggcccggtaccaggatccccaaggccgccgtccaggtgctggacgacatcgagaaatgcctggaaaagaaacaacaaagcgtg

SEQ ID NO: 759 - DNA, 2250 bp, Artificial Sequence
  Codon optimized sequence that encodes an MCM polypeptide with the I671V mutation
atgctgcgcgccaagaatcagctgttcctgctgagcccccactacctgcgccaggtgaaggaatcgagcggatcgaggctgatccagcagaggctgcttcaccagcagcaaccccttcaccccgagtgggccgcactggcgaagaagcaactgaagggtaagaaccccgaagacttaatctggcacacccccgaagggatcagcatcaagcccctgtacagcaaaagggacaccatggacctgccggaggagctgcccggggtgaagcccttcaccaggggcccctaccccacgatgtacaccttccggccctggactatccgtcagtacgccggcttttccacagtggaggagagcaacaagttttataaggacaacatcaaggccggccagcaaggcctgagcgtggcgtttgacctggccacccacaggggctacgactccgacaacccacgggtgaggggcgacgtcggcatggccggggtggccatcgacaccgtggaggacaccaagatcctgttcgacggcatccccctcgagaaaatgagcgtgtccatgaccatgaacggcgccgtgattccggtgctggccaacttcattgtcaccggagaggagcaaggcgtgccaaaggagaagctgaccgggaccatccagaacgacattctgaaagagttcatggtgcgcaacacgtacatattcccccccgagcccagcatgaagatcatcgctgacatcttcgagtacaccgccaagcatatgcccaagttcaacagcatcagcatctccggctaccacatgcaagaagccggcgccgatgccatactcgagctcgcctacaccctggccgatggtctggaatactccaggacgggcctgcaggcgggcctcaccatcgacgagtttgcgcccaggctgagcttcttttggggcatcggcatgaacttctacatggaaatcgccaagatgagggccggcaggcgcctgtgggcgcacctcatcgagaagatgttccagccgaagaactccaaaagcctgctgctgcgggcccattgtcagacctccggctggtccctcacggagcaggatccctacaataacatcgtgcgcaccgccatcgaggcaatggccgccgttttcgggggcacgcagagcctgcacacaaacagcttcgacgaggcgctgggcctgcccaccgtcaagtccgccaggatcgcccgaaacacccagatcatcatccaggaggagagcgggatcccgaaagtggcggacccctggggcggcagctatatgatggagtgcctgaccaacgacgtctacgacgccgccctgaagctgatcaacgagatcgaggaaatgggcgggatggcgaaggccgtcgccgagggcatccccaagctgcgcattgaggagtgcgccgcgaggcgccaggcccggatcgatagcggctccgaggtgatcgtcggggtcaacaaataccaactggagaaggaggacgccgtagaagtgctcgcgatcgacaacaccagcgtgaggaaccgccagatcgaaaagctcaagaagatcaagagcagccgggatcaagccctggccgagagatgcctggccgcgctcactgagtgcgccgccagcggggacggcaacatcctggcgctggccgtggatgccagccgcgccaggtgcaccgtcggcgagatcacggacgccctgaagaaggtcttcggagagcacaaggccaacgaccggatggtcagcggcgcgtacaggcaggagttcggcgagtctaaggagatcacctccgccatcaaaagggtgcacaaattcatggaacgggagggcaggaggccgaggctgctggtggccaagatgggccaggacgggcacgatcgcggcgccaaggtcatcgccacgggcttcgccgacctgggtttcgacgtggacatcggcccactgttccagaccccccgggaggtggcccagcaggccgtggatgccgacgtgcacgccgtgggcgtgagcaccctggccgccggacacaagaccctcgtgcccgagctcataaaggagctgaacagcctgggcaggcccgacatactggtgatgtgcgggggcgtgatcccccctcaagactatgagtttctgtttgaggtcggggtgtccaacgtgttcggaccgggcacccgcatcccgaaggccgccgtgcaggtgctggacgacatcgagaagtgcctggagaaaaaacaacagagcgtg

SEQ ID NO: 760 - DNA, 2250 bp, Artificial Sequence
  Codon optimized sequence that encodes an MCM polypeptide with the I671V mutation
atgcttcgggcgaagaaccagctgttcctgctgtccccgcactacctcaggcaggtgaaggagagctccggcagccgcctgatccagcagaggctgctgcaccagcagcagcccctgcacccggagtgggccgcgctggccaagaagcagctgaagggcaagaaccccgaggacctgatatggcacacccccgagggcatctccatcaagccgctgtattcgaagagggacaccatggacctgcctgaggagctgcctggggtaaagcccttcaccagggggccctaccccaccatgtacacctttcggccatggaccatccggcaatatgccgggttctcaaccgtggaggagagcaacaagttctacaaggacaacattaaggcggggcagcaggggctgtccgtggcgttcgacctggccacccaccggggctatgacagcgacaatccccgggtgaggggggacgtgggcatggcgggcgtggccatcgatacagtcgaggacacgaagatactgtttgacggcatccccctggagaaaatgtcggtgtcgatgacgatgaacggcgccgtgatcccggtgctggccaacttcatcgtgaccggcgaggagcagggggtgcctaaggagaaactgaccgggaccatccagaacgacatcctgaaggagttcatggtgcgcaacacctacatatttccccccgagcccagcatgaagatcatcgccgacatcttcgaatacaccgccaagcatatgcccaagttcaacagcatcagcatctccgggtaccacatgcaggaggccggcgccgacgccatcctggaactggcctacaccctggccgacggcctggagtacagcagaaccgggctccaggcaggcctgaccatcgacgagttcgccccacggctgtccttcttctgggggatcggcatgaacttctatatggagatcgccaagatgagggccgggcggaggctctgggcccatctgatcgagaagatgttccagccaaagaacagcaagagcctcctgctgagggcccactgccagaccagcggctggtccctgaccgagcaggacccctacaacaacatcgtcaggacggccatcgaggcgatggccgccgtgtttggaggcacccagagcctgcataccaacagcttcgacgaggccctgggcctgcccactgtgaagagcgccaggatcgccaggaacacccagatcatcatccaggaggagagcggcatccccaaggtggcggacccttggggtggctcctacatgatggaatgcctcacaaatgatgtgtacgacgccgccctcaaactgatcaacgaaatcgaggagatgggtggcatggccaaagccgtagcggagggcatccccaagctccggatcgaggagtgcgccgccaggcgacaggcccggatcgacagcggctccgaggtcatcgtcggggtgaacaagtaccagctcgaaaaggaggacgccgtggaggtgctggcgatcgacaacaccagcgtgcggaacaggcagatagagaagctgaagaagatcaagagcagtagggaccaggccctcgccgagaggtgtctggccgccctgaccgagtgcgccgcctccggcgatggcaacatcctggcccttgccgtggacgcgagccgcgccaggtgcaccgtgggcgagatcaccgacgccctgaagaaggtgtttggcgaacacaaggccaacgacaggatggtgtccggcgcctaccgtcaggagttcggcgagagcaaggagatcaccagcgccatcaagagggtgcacaagtttatggaacgcgaagggaggcgccccaggctgctggtggccaagatggggcaggacgggcacgacaggggcgccaaagtcatcgccaccggctttgccgacctgggattcgatgtggacatcggccccctgtttcagacccccagagaggtcgcccaacaggcggtcgacgccgacgtccatgccgtcggcgtgagcaccctggccgccgggcacaagacgctcgtgcccgagctgatcaaggagctgaacagcctgggcaggcccgacatcttagtgatgtgcgggggggtgattcccccccaggactatgagttccttttcgaagtgggtgtcagcaacgtgttcggcccgggcacccgcatccccaaggctgcggtccaggtgctggacgacatcgagaagtgcctggagaagaaacagcaatccgtg

SEQ ID NO: 761 - DNA, 2250 bp, Artificial Sequence
  Codon optimized sequence that encodes an MCM polypeptide with the I671V mutation
atgctgagggccaagaaccagctgtttctcctgtcgccccactacctgaggcaggtgaaggagtcctccggcagcaggctcattcagcagaggctgttgcaccagcagcagcccctgcacccagagtgggccgccctcgccaagaagcagctgaaggggaagaaccccgaggacctgatctggcatacgcccgagggtatctccataaaacccctctacagtaagagggacaccatggacctgcccgaggaactgcccggcgtgaagccgttcacgcggggcccataccccaccatgtacaccttccggccgtggaccatcaggcaatacgccggcttcagcaccgtggaggagagcaacaagttctacaaagacaacatcaaagccggtcagcaagggctgagcgtagccttcgacctggccacccacaggggctacgactccgacaaccccagggtgcgcggcgacgtgggcatggccggcgtggccatcgacaccgtggaagacaccaagatcctcttcgacggcatccccctggaaaagatgtccgtgtccatgaccatgaacggggccgttataccggtgctggccaacttcatagtcaccggcgaggagcagggggtcccgaaggagaagttaaccggcacgattcagaacgacatcctgaaagagttcatggtgaggaacacctatatcttcccccccgagccctccatgaaaatcatcgccgacatcttcgagtacaccgcgaagcacatgcccaagttcaactccatcagcatctccggatatcacatgcaggaagccggcgccgacgccatcctggagctggcctacaccctggcggacggactggagtacagccgcacgggcctgcaggcgggcctgaccatagacgaatttgccccgcggctgagctttttctgggggatcggcatgaatttctacatggagatcgccaagatgcgggccggcagacggctgtgggcccatctgatcgaaaaaatgttccagcccaaaaacagcaagtccctgctgctgcgggcccactgccagaccagcggctggagcctgaccgagcaggacccgtacaataacatcgtgaggaccgccatcgaggccatggccgccgtgttcggcgggacgcaaagcctgcacacgaactccttcgacgaggcgctcggcctgcccaccgtgaagtccgctaggatcgccaggaacacacagatcatcatccaggaggagagcggcatccccaaggtggccgacccctggggcggctcctacatgatggagtgcctgacgaacgacgtgtacgacgccgccctgaagctgatcaacgagatcgaggagatgggcggcatggccaaggccgtcgccgagggcatccccaagctgcgcatcgaggagtgcgccgccaggcgccaagcccggatcgatagcggcagcgaggtgatcgtgggggtgaacaagtaccagctggagaaggaggacgcggtcgaggtcctggccatagacaacacgagcgtgcggaacaggcagatcgagaagctcaagaaaatcaagagcagccgggaccaggccctggccgaaaggtgcctcgccgccctcacggaatgcgccgccagcggcgacggcaatatcctggccctggcggtcgatgccagccgcgctcggtgcaccgtgggggagatcaccgatgccctcaagaaagtgttcggggagcacaaggccaacgacaggatggtgtccggcgcctacaggcaggagttcggcgaaagcaaggaaatcacgagcgccatcaagcgggtccataagttcatggagagggagggccggaggcccaggctgctcgtggccaaaatgggccaggacggccatgacaggggcgccaaggtgatcgccaccgggttcgccgacctcggcttcgacgtggacatcgggccgctgttccagacgccgcgggaggtcgcccagcaagcggtggacgccgacgtgcacgccgtcggggtgagcaccctcgccgctgggcataagaccctggtgcccgagctgatcaaagagctcaacagcctcggcaggcccgacattctcgttatgtgcggcggcgtcatcccgccccaggactacgagttcctgtttgaggtcggcgtctccaacgtgttcggcccaggcaccaggatccccaaggccgccgtgcaggtgttggacgatatcgagaaatgcctcgagaaaaagcagcagagcgtc

SEQ ID NO: 762 - DNA, 2250 bp, Artificial Sequence
  Codon optimized sequence that encodes an MCM polypeptide with the I671V mutation
atgctgagggcgaagaatcagctgtttctgctgagcccccactacctcaggcaggtgaaggagagcagcggcagcaggctgatccagcagaggctgctgcaccagcagcaacccctgcaccccgagtgggcggccctggccaagaagcagctcaagggcaagaaccctgaagacctgatctggcacacccccgagggaatcagcatcaagccgctgtactccaagagggacaccatggacctgcccgaggagctccccggcgtcaagcccttcacccggggcccctaccccaccatgtacaccttcaggccctggaccatccgccagtacgcgggcttctccaccgtggaagagtccaacaagttctacaaggacaacatcaaggccgggcaacagggcctctccgtggccttcgacctggccacgcaccggggttacgattctgacaacccgcgcgtgcggggcgacgtcgggatggccggggtcgcgatcgacaccgtcgaggataccaagatcctgttcgacggcatccccctcgagaagatgagcgtcagcatgaccatgaacggcgccgtgatccccgtgctggccaacttcatcgtcaccggcgaggagcagggggtccccaaagagaagctaaccggcaccatccagaacgacatcctgaaggagttcatggtgaggaacacctatatcttcccgcccgagcccagcatgaagatcatcgccgacatcttcgagtacaccgccaagcacatgcccaagttcaacagcataagcatcagcgggtaccacatgcaggaggccggtgcggacgccatcctcgagctcgcctataccctggcagacggtctggagtacagcaggaccggactgcaagccgggctgacgatcgacgaattcgcccccaggctgagcttcttctggggtattggcatgaacttctacatggagatcgccaagatgagggccggcaggcggctctgggcccacctcatcgagaagatgttccagcccaagaacagcaagtccctgctgctcagggcccactgccagacaagcgggtggagcctcaccgagcaggacccgtacaacaacatcgtgcgcaccgccatcgaagccatggcggccgtcttcggcggcacccagagcctgcataccaacagcttcgacgaggctctgggcctgcccacggtgaagtccgccaggatcgcccggaacacccagattataatccaggaagagagcggcattcccaaggtggcggacccatggggtggcagctacatgatggaatgcctcaccaatgacgtgtacgacgcggccctgaagctgatcaacgagatcgaggagatgggggggatggccaaggccgtggccgagggcatccccaagctgaggatcgaagagtgcgccgcccgaaggcaggcccggatcgacagcggcagcgaagtcatcgtgggcgtgaacaagtaccaactcgagaaggaggacgcagtcgaagtgctcgccatcgacaacaccagcgtgaggaaccggcagatcgagaagctgaagaagatcaagtcctccagagaccaggccctggccgagaggtgcctggccgccctgacggaatgcgccgccagcggcgacggaaacatcctggccctggccgtagacgccagcagggccaggtgtaccgtgggcgagatcacggacgcgctgaaaaaggtctttggcgagcacaaagccaacgacaggatggtgagcggcgcctatcgccaggagttcggcgagtccaaggaaatcaccagcgccatcaagcgggtccacaagttcatggagagggagggacgccgcccccggctgctggtggccaagatgggccaggacgggcatgacaggggggccaaggtgatcgccacgggctttgccgatctgggcttcgatgtggacatcggccccctgtttcagacgcccagagaggtggcccaacaggccgtggacgccgacgtgcacgccgtgggtgtctccaccctggccgccggccacaagacgctcgtgcccgagctgatcaaggagctgaactccctgggccgccccgatatcctggtgatgtgcgggggggtgatccccccccaggactacgagttcctgtttgaggtgggcgtgtccaacgtgttcgggcccggcaccaggatccccaaggccgccgtgcaggtgctggacgacatcgagaagtgtctggaaaaaaagcaacagagcgtg

SEQ ID NO: 763 - DNA, 2250 bp, Artificial Sequence
  Codon optimized sequence that encodes an MCM polypeptide with the I671V mutation
atgctgagggccaagaaccagctgtttctgctgagcccccactacctgcggcaggtgaaggaaagctccggcagccggctgattcagcagcgcctgctgcaccagcagcagcccctgcatcccgagtgggccgccctggccaagaagcagctgaagggcaagaaccccgaggacctgatctggcatacccccgaagggatctccatcaagcccctgtactccaagagggatacgatggacttgcccgaagagctccccggcgtgaaacccttcacccggggcccttacccgactatgtacaccttcaggccctggaccatcaggcagtacgccggcttctccaccgtggaggagagcaacaagttctacaaggataatatcaaggccggccagcagggcctcagcgtggccttcgacctggccacccaccgtggctacgacagcgacaacccccgcgtccggggcgatgtgggaatggccggcgtggccatcgataccgtggaggatacgaagatactattcgacggtatccccctggagaagatgagcgtgagcatgaccatgaacggcgcggtgatacccgtgctggccaacttcatcgtcacgggggaggagcaaggcgtgcccaaagaaaagctgaccggcaccatccagaacgacatcctcaaggaattcatggtgcggaacacctacatcttcccccccgagccctccatgaagattatcgccgatatcttcgagtacaccgccaagcacatgcccaagttcaatagcatctccatctccggctaccacatgcaagaggccggcgccgacgcaatcctggagctggcctacacactcgccgatggcctggagtattccaggaccggcctgcaggccggcctgaccatcgacgagttcgcccccaggctgagcttcttttggggcattggcatgaatttctacatggagatcgcgaagatgagggccggccggcggctgtgggcacacctgatcgaaaagatgttccaacccaagaacagtaagagcctgctgctgagggcccactgccagaccagcggctggagcctgaccgagcaggacccctacaataacattgtgcggaccgccatcgaggcgatggccgccgtgttcggcggcacacagagcctgcacaccaacagctttgatgaggccctcggcctgcccacggtgaagtccgccaggatcgccaggaacactcagatcatcatccaggaggaaagcggcatccccaaagtggccgacccctggggcggcagctacatgatggagtgcctgaccaacgacgtctacgatgccgccctgaaactcatcaacgagattgaggagatgggcggcatggccaaggccgtggccgaggggatccccaaactgaggatcgaagagtgcgccgcccggaggcaggcccgtatcgactccggctccgaggtcatcgtgggggtgaataaataccagctggaaaaggaggacgccgtggaggtcctcgccatcgacaacacctcggtccgcaaccggcagatcgagaagctcaaaaagatcaagtcctcgagggatcaggccctcgccgagaggtgcctggccgccctgacggagtgcgcggccagcggggatggcaacatcctcgccctggcggtggacgcctcccgcgccagatgtactgtcggcgagatcaccgacgccctcaagaaagtgttcggcgagcacaaggccaacgacaggatggtgtccggcgcctatcgtcaggagtttggcgagtccaaggaaatcaccagcgccatcaagagggtgcacaagttcatggagagggaggggcggcgaccccgcctgctggtggccaagatgggtcaggacgggcacgataggggcgccaaggtgattgccaccggattcgccgacctgggcttcgacgtggacatcggccccctgttccagacacccagggaagtggcccagcaggccgtggacgcggacgtgcacgccgtgggcgtgtcgaccctcgccgccggtcataagaccctcgtgcccgagctgatcaaggagctgaacagcctgggcaggcccgatatcctggtgatgtgtgggggcgtaatccccccgcaggattacgagttcctgttcgaagtgggggtgtccaacgtgttcgggcccggcacccggattcccaaggcggccgtgcaggtgctggacgacatcgagaagtgtctggaaaagaagcaacagagcgtg

SEQ ID NO: 764 - DNA, 2250 bp, Artificial Sequence
  Codon optimized sequence that encodes an MCM polypeptide with the I671V mutation
atgctgagggcaaaaaaccagctcttcctgctcagcccccactacctcaggcaagtgaaggagtcctccggctcccgtctgattcagcagaggctgctgcaccagcagcagcccctgcaccccgagtgggccgccctcgcgaagaaacagctcaaggggaagaacccggaggacctcatctggcacacccccgagggaatcagcatcaagcccctctactccaagagggataccatggacctgcccgaggagctgcccggcgtgaaacccttcacccgtggcccctaccccacgatgtacaccttcaggccctggaccatccgccagtacgccggcttctccaccgtggaggagtccaacaaattctacaaagacaatatcaaggccggacaacagggcctctccgtggcattcgatctggctacacacagggggtacgactccgacaaccccagggtgcggggcgacgtcggtatggccggggtcgccatcgacacggtggaagacaccaagatcctgtttgacggcatccccctggagaaaatgagcgtgtccatgaccatgaacggcgccgtgatccccgtcctggccaacttcatcgtgaccggcgaagagcagggcgtgcccaaagagaagctgaccggtaccatccaaaacgacatcctgaaagagtttatggtccggaacacctacatcttcccccccgagcccagcatgaaaatcattgcagatatattcgagtacaccgccaaacatatgcccaagttcaacagcatctccatatccgggtatcacatgcaggaggccggggccgacgccatcctggagctggcctacaccctggccgacggcctggagtattcccgaacgggcctccaggccgggctgacaatcgacgagttcgcccccaggttgagcttcttctggggcataggaatgaacttctacatggaaatagccaagatgagggccggcaggagactgtgggcccacctgatcgagaagatgttccagcccaagaacagcaagagcctgctgctgcgggcccactgccagaccagtggctggtccctgaccgagcaggacccctacaataacatcgtcaggaccgccatcgaggccatggcggccgtgttcggaggcacgcagagcctccacaccaacagcttcgacgaggccctgggcctgcccacggtgaagagcgcccggatcgcccgcaacacccagatcatcatccaggaggagagcggcatccccaaggtggccgacccctggggcggtagctacatgatggagtgcctgaccaacgacgtctacgatgcggccctcaagctgatcaacgagatcgaggagatgggcgggatggccaaagccgtcgccgagggaatcccgaagctgaggatagaggagtgcgccgcgaggcgccaggccaggatcgattccggctccgaggtgatcgtgggcgtgaacaagtaccagctcgagaaggaggacgccgtggaggtgctggccatagacaacacctccgtgcggaaccgccagatcgagaaactgaagaagatcaagtccagccgcgaccaggccctggccgagcggtgtctggccgcgctcactgagtgcgccgccagcggcgacggaaacatactggccctggccgtggacgcctcccgcgccaggtgcacggtgggagagatcaccgacgccctgaagaaggtgttcggggaacacaaggccaacgatcggatggtctccggcgcctaccgacaggagttcggcgaaagcaaggagattaccagcgccatcaagcgggtgcacaagtttatggagagggagggccggaggccccggctgctcgtggccaagatgggccaggatggacacgatcgaggggccaaagtcatcgccaccgggttcgccgacctcggcttcgacgtggacatcgggccgctgttccagacccccagggaggtcgcccagcaggccgtggatgccgacgtgcacgccgtcggcgtttccaccctggccgccggccataagaccctggtgcccgagctgatcaaggagctgaactcactcggccggcccgacatcctcgtgatgtgcgggggcgtcatacccccgcaggactacgagtttctgttcgaggtgggggtttccaacgtgttcggcccgggcacccggatccccaaagccgccgtgcaggtgctcgatgacattgaaaagtgtctggagaagaaacagcaatccgtg

SEQ ID NO: 765 - DNA, 2250 bp, Artificial Sequence
  Codon optimized sequence that encodes an MCM polypeptide with the I671V mutation
atgctgagggccaagaaccagctgttcctgctgtctccccactatctaaggcaggtcaaggagagcagcggcagcaggctgatccagcagcgtcttctgcaccagcagcagccactgcatcccgagtgggccgccctggccaagaagcagctgaagggcaagaaccccgaggacctgatctggcacacccctgagggcatcagcatcaagcccctgtactcaaaacgcgacaccatggacctgcccgaagagctgcccggggtgaagcccttcacccggggcccataccccacgatgtacacctttaggccgtggaccatcaggcagtatgccggcttctcaaccgtggaggagagcaacaagttttacaaagacaacatcaaggccggccagcagggcctgtccgtggccttcgacctggccacacaccgggggtacgacagcgacaacccccgcgtgcgtggtgatgtcgggatggccggagtggccatagacacggtggaggacaccaagatcctgttcgacggcatccccctggaaaagatgagcgtgagcatgaccatgaacggcgccgtcatccccgtgctggcaaacttcatcgtgaccggcgaggagcagggcgtgccgaaggagaagctgaccggcaccatccagaacgacatcctgaaggaatttatggtcaggaatacctacatcttcccacccgagccctccatgaagatcatcgccgacatcttcgaatacaccgccaagcatatgcccaaattcaatagcatcagcatcagcggttaccacatgcaggaagccggcgcggacgccatcctggagctggcctacaccctggcagatggcctggagtactcccgaacgggactgcaggccgggctgaccatcgacgagttcgcccccaggctgagcttcttttggggcatcggcatgaacttctacatggaaatcgccaaaatgcgtgcgggcaggaggctgtgggcccatctgatcgagaagatgttccagcccaagaacagcaagtccctcctgctcagggcccactgtcaaaccagcgggtggtcgctgaccgagcaggacccctacaacaacatcgtccggaccgccattgaggcgatggccgccgtgtttgggggcacccagtccctgcacaccaacagcttcgacgaggccctggggctgccaaccgtcaagagcgcccggatcgcgaggaacacccagatcataatccaggaggagtccggcatccccaaggtcgccgacccatggggcggctcctacatgatggagtgcctcaccaacgacgtgtacgacgccgccctgaagctgatcaacgaaatcgaggagatgggcggaatggccaaagccgtggccgagggcatcccgaagctgaggattgaggagtgcgccgccaggcggcaggcccggatcgacagcggcagcgaggtgatcgtgggcgtgaacaagtatcagctggagaaagaggacgcggtggaggtcctggccatcgacaatacctcggtgaggaaccgccagatcgagaagctgaaaaagatcaagtcctccagggaccaggccctggccgagcgatgcctcgccgccctgaccgagtgcgccgcctccggcgacgggaacatcctggccctggcggtggacgccagccgggccaggtgtaccgtgggcgagatcaccgacgccctgaagaaggtgttcggcgagcataaggccaacgatcgcatggtcagcggcgcctacaggcaggagttcggagagagcaaggagattaccagcgccatcaagagggtgcacaagttcatggaacgggaggggaggcggcccaggctgcttgtggcgaagatgggccaggatggccacgacaggggcgccaaggtgatcgccaccggcttcgccgacctggggttcgatgtggacatcggacccctgtttcagacccccagggaggtggcccaacaggctgtggacgccgacgtgcacgccgtcggcgtctccaccctggccgccggacacaagaccctggtgcccgagctgatcaaagagctgaacagcctggggaggccggatatcctggtgatgtgcggcggggtcatccccccccaagactacgagttcctgttcgaagtgggagtcagcaacgtcttcgggcccggcacccggatcccgaaggccgccgtccaggtgctggacgacatcgagaagtgcctggagaagaaacagcagagcgtg

SEQ ID NO: 766 - DNA, 2506 bp, Artificial Sequence
  mRNAs encoding human MCM
tcaagcttttggaccctcgtacagaagctaatacgactcactatagggaaataagagagaaaagaagagtaagaagaaatataagagccaccatgctgcgggccaagaaccagctgttcctgctgagcccccactacctgcggcaggtgaaggagagcagcggcagccggctgatccagcagcggctgctgcaccagcagcagcccctgcaccccgagtgggccgccctggccaagaagcagctgaagggcaagaaccccgaggacctgatctggcacacccccgagggcatcagcatcaagcccctgtacagcaagcgggacaccatggacctgcccgaggagctgcccggcgtgaagcccttcacccggggcccctaccccaccatgtacaccttccggccctggaccatccggcagtacgccggcttcagcaccgtggaggagagcaacaagttctacaaggacaacatcaaggccggccagcagggcctgagcgtggccttcgacctggccacccaccggggctacgacagcgacaacccccgggtgcggggcgacgtgggcatggccggcgtggccatcgacaccgtggaggacaccaagatcctgttcgacggcatccccctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgcggaacacctacatcttcccccccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagccggaccggcctgcaggccggcctgaccatcgacgagttcgccccccggctgagcttcttctggggcatcggcatgaacttctacatggagatcgccaagatgcgggccggccggcggctgtgggcccacctgatcgagaagatgttccagcccaagaacagcaagagcctgctgctgcgggcccactgccagaccagcggctggagcctgaccgagcaggacccctacaacaacatcgtgcggaccgccatcgaggccatggccgccgtgttcggcggcacccagagcctgcacaccaacagcttcgacgaggccctgggcctgcccaccgtgaagagcgcccggatcgcccggaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgcggatcgaggagtgcgccgcccggcggcaggcccggatcgacagcggcagcgaggtgatcgtgggcgtgaacaagtaccagctggagaaggaggacgccgtggaggtgctggccatcgacaacaccagcgtgcggaaccggcagatcgagaagctgaagaagatcaagagcagccgggaccaggccctggccgagcggtgcctggccgccctgaccgagtgcgccgccagcggcgacggcaacatcctggccctggccgtggacgccagccgggcccggtgcaccgtgggcgagatcaccgacgccctgaagaaggtgttcggcgagcacaaggccaacgaccggatggtgagcggcgcctaccggcaggagttcggcgagagcaaggagatcaccagcgccatcaagcgggtgcacaagttcatggagcgggagggccggcggccccggctgctggtggccaagatgggccaggacggccacgaccggggcgccaaggtgatcgccaccggcttcgccgacctgggcttcgacgtggacatcggccccctgttccagaccccccgggaggtggcccagcaggccgtggacgccgacgtgcacgccgtgggcgtgagcaccctggccgccggccacaagaccctggtgcccgagctgatcaaggagctgaacagcctgggccggcccgacatcctggtgatgtgcggcggcgtgatccccccccaggactacgagttcctgttcgaggtgggcgtgagcaacgtgttcggccccggcacccggatccccaaggccgccgtgcaggtgctggacgacatcgagaagtgcctggagaagaagcagcagagcgtgtgataatagtccataaagtaggaaacactacagctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 767 - DNA, 2484 bp, Artificial Sequence
  mRNAs encoding human MCM
tcaagcttttggaccctcgtacagaagctaatacgactcactatagggaaataagagagaaaagaagagtaagaagaaatataagagccaccatgctgcgggccaagaaccagctgttcctgctgagcccccactacctgcggcaggtgaaggagagcagcggcagccggctgatccagcagcggctgctgcaccagcagcagcccctgcaccccgagtgggccgccctggccaagaagcagctgaagggcaagaaccccgaggacctgatctggcacacccccgagggcatcagcatcaagcccctgtacagcaagcgggacaccatggacctgcccgaggagctgcccggcgtgaagcccttcacccggggcccctaccccaccatgtacaccttccggccctggaccatccggcagtacgccggcttcagcaccgtggaggagagcaacaagttctacaaggacaacatcaaggccggccagcagggcctgagcgtggccttcgacctggccacccaccggggctacgacagcgacaacccccgggtgcggggcgacgtgggcatggccggcgtggccatcgacaccgtggaggacaccaagatcctgttcgacggcatccccctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgcggaacacctacatcttcccccccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagccggaccggcctgcaggccggcctgaccatcgacgagttcgccccccggctgagcttcttctggggcatcggcatgaacttctacatggagatcgccaagatgcgggccggccggcggctgtgggcccacctgatcgagaagatgttccagcccaagaacagcaagagcctgctgctgcgggcccactgccagaccagcggctggagcctgaccgagcaggacccctacaacaacatcgtgcggaccgccatcgaggccatggccgccgtgttcggcggcacccagagcctgcacaccaacagcttcgacgaggccctgggcctgcccaccgtgaagagcgcccggatcgcccggaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgcggatcgaggagtgcgccgcccggcggcaggcccggatcgacagcggcagcgaggtgatcgtgggcgtgaacaagtaccagctggagaaggaggacgccgtggaggtgctggccatcgacaacaccagcgtgcggaaccggcagatcgagaagctgaagaagatcaagagcagccgggaccaggccctggccgagcggtgcctggccgccctgaccgagtgcgccgccagcggcgacggcaacatcctggccctggccgtggacgccagccgggcccggtgcaccgtgggcgagatcaccgacgccctgaagaaggtgttcggcgagcacaaggccaacgaccggatggtgagcggcgcctaccggcaggagttcggcgagagcaaggagatcaccagcgccatcaagcgggtgcacaagttcatggagcgggagggccggcggccccggctgctggtggccaagatgggccaggacggccacgaccggggcgccaaggtgatcgccaccggcttcgccgacctgggcttcgacgtggacatcggccccctgttccagaccccccgggaggtggcccagcaggccgtggacgccgacgtgcacgccgtgggcgtgagcaccctggccgccggccacaagaccctggtgcccgagctgatcaaggagctgaacagcctgggccggcccgacatcctggtgatgtgcggcggcgtgatccccccccaggactacgagttcctgttcgaggtgggcgtgagcaacgtgttcggccccggcacccggatccccaaggccgccgtgcaggtgctggacgacatcgagaagtgcctggagaagaagcagcagagcgtgtgataataggctggagcctcggtggccatgcttcttgccccttgggcctccccccagcccctcctccccttcctgcacccgtaccccctccataaagtaggaaacactacagtggtctttgaataaagtctgagtgggcggc

SEQ ID NO: 768 - DNA, 2250 bp, Artificial Sequence; identical to SEQ ID NO: 182
  mRNAs encoding human MCM

SEQ ID NO: 769 - DNA, 2506 bp, Artificial Sequence
  mRNAs encoding human MCM
tcaagcttttggaccctcgtacagaagctaatacgactcactatagggaaataagagagaaaagaagagtaagaagaaatataagagccaccatgctgcgggccaagaaccagctgttcctgctgagccctcactacctgcggcaggtgaaggagagcagcggcagccggctgatccagcagcggctgctgcaccagcagcagcccctgcaccccgagtgggccgccctggccaagaagcagctgaagggcaagaaccccgaggacctgatctggcacacgcccgagggcatcagcatcaagcccctgtacagcaagcgggacaccatggacctgcccgaggagctgcccggcgtgaagcccttcacccggggcccctaccccaccatgtacaccttccggccctggaccatccggcagtacgccggcttcagcaccgtggaggagagcaacaagttctacaaggacaacatcaaggccggccagcagggcctgagcgtggccttcgacctggccacccaccggggctacgacagcgacaacccacgggtgcggggcgacgtgggcatggccggcgtggccatcgacaccgtggaggacaccaagatcctgttcgacggcatccctctggagaagatgagcgtgagcatgaccatgaacggcgccgtgatccccgtgctggccaacttcatcgtgaccggcgaggagcagggcgtgcccaaggagaagctgaccggcaccatccagaacgacatcctgaaggagttcatggtgcggaacacctacatcttccctcccgagcccagcatgaagatcatcgccgacatcttcgagtacaccgccaagcacatgcccaagttcaacagcatcagcatcagcggctaccacatgcaggaggccggcgccgacgccatcctggagctggcctacaccctggccgacggcctggagtacagccggaccggcctgcaggccggcctgaccatcgacgagttcgcgccccggctgagcttcttctggggcatcggcatgaacttctacatggagatcgccaagatgcgggccggccggcggctgtgggcccacctgatcgagaagatgttccagcccaagaacagcaagagcctgctgctgcgggcccactgccagaccagcggctggagcctgaccgagcaggacccctacaacaacatcgtgcggaccgccatcgaggccatggccgccgtgttcggcggcacccagagcctgcacaccaacagcttcgacgaggccctgggcctgcccaccgtgaagagcgcccggatcgcccggaacacccagatcatcatccaggaggagagcggcatccccaaggtggccgacccctggggcggcagctacatgatggagtgcctgaccaacgacgtgtacgacgccgccctgaagctgatcaacgagatcgaggagatgggcggcatggccaaggccgtggccgagggcatccccaagctgcggatcgaggagtgcgccgcccggcggcaggcccggatcgacagcggcagcgaggtgatcgtgggcgtgaacaagtaccagctggagaaggaggacgccgtggaggtgctggccatcgacaacaccagcgtgcggaaccggcagatcgagaagctgaagaagatcaagagcagccgggaccaggccctggccgagcggtgcctggccgccctgaccgagtgcgccgccagcggcgacggcaacatcctggccctggccgtggacgccagccgggcccggtgcaccgtgggcgagatcaccgacgccctgaagaaggtgttcggcgagcacaaggccaacgaccggatggtgagcggcgcctaccggcaggagttcggcgagagcaaggagatcaccagcgccatcaagcgggtgcacaagttcatggagcgggagggccggcggccccggctgctggtggccaagatgggccaggacggccacgaccggggcgccaaggtgatcgccaccggcttcgccgacctgggcttcgacgtggacatcggcccactgttccagacgccccgggaggtggcccagcaggccgtggacgccgacgtgcacgccgtgggcgtgagcaccctggccgccggccacaagaccctggtgcccgagctgatcaaggagctgaacagcctgggccggcccgacatcctggtgatgtgcggcggcgtgatcccgccccaggactacgagttcctgttcgaggtgggcgtgagcaacgtgttcggccccggcacccggatccccaaggccgccgtgcaggtgctggacgacatcgagaagtgcctggagaagaagcagcagagcgtgtgataatagtccataaagtaggaaacactacagctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 770 - DNA, 2483 bp, Artificial Sequence
  mRNAs encoding human MCM
tcaagcttttggaccctcgtacagaagctaatacgactcactatagggaaataagagagaaaagaagagtaagaagaaatataagagccaccatgctgcgggccaagaaccagctgttcctgctgagcccccactacctgcggcaggtgaaggagagcagcggcagccggctgatccagcagcgcctcctccaccagcagcagcccctccaccccgagtgggccgccctcgccaagaagcagctcaagggcaagaaccccgaggacctcatctggcacacccccgagggcatctccatcaagcccctctactccaagcgcgacaccatggacctccccgaggagctccccggcgtcaagcccttcacccgcggcccctaccccaccatgtacaccttccgcccctggaccatccgccagtacgccggcttctccaccgtcgaggagtccaacaagttctacaaggacaacatcaaggccggccagcagggcctctccgtcgccttcgacctcgccacccaccgcggctacgactccgacaacccccgcgtccgcggcgacgtcggcatggccggcgtcgccatcgacaccgtcgaggacaccaagatcctcttcgacggcatccccctcgagaagatgtccgtctccatgaccatgaacggcgccgtcatccccgtcctcgccaacttcatcgtcaccggcgaggagcagggcgtccccaaggagaagctcaccggcaccatccagaacgacatcctcaaggagttcatggtccgcaacacctacatcttcccccccgagccctccatgaagatcatcgccgacatcttcgagtacaccgccaagcacatgcccaagttcaactccatctccatctccggctaccacatgcaggaggccggcgccgacgccatcctcgagctcgcctacaccctcgccgacggcctcgagtactcccgcaccggcctccaggccggcctcaccatcgacgagttcgccccccgcctctccttcttctggggcatcggcatgaacttctacatggagatcgccaagatgcgcgccggccgccgcctctgggcccacctcatcgagaagatgttccagcccaagaactccaagtccctcctcctccgcgcccactgccagacctccggctggtccctcaccgagcaggacccctacaacaacatcgtccgcaccgccatcgaggccatggccgccgtcttcggcggcacccagtccctccacaccaactccttcgacgaggccctcggcctccccaccgtcaagtccgcccgcatcgcccgcaacacccagatcatcatccaggaggagtccggcatccccaaggtcgccgacccctggggcggctcctacatgatggagtgcctcaccaacgacgtctacgacgccgccctcaagctcatcaacgagatcgaggagatgggcggcatggccaaggccgtcgccgagggcatccccaagctccgcatcgaggagtgcgccgcccgccgccaggcccgcatcgactccggctccgaggtcatcgtcggcgtcaacaagtaccagctcgagaaggaggacgccgtcgaggtcctcgccatcgacaacacctccgtccgcaaccgccagatcgagaagctcaagaagatcaagtcctcccgcgaccaggccctcgccgagcgctgcctcgccgccctcaccgagtgcgccgcctccggcgacggcaacatcctcgccctcgccgtcgacgcctcccgcgcccgctgcaccgtcggcgagatcaccgacgccctcaagaaggtcttcggcgagcacaaggccaacgaccgcatggtctccggcgcctaccgccaggagttcggcgagtccaaggagatcacctccgccatcaagcgcgtccacaagttcatggagcgcgagggccgccgcccccgcctcctcgtcgccaagatgggccaggacggccacgaccgcggcgccaaggtcatcgccaccggcttcgccgacctcggcttcgacgtcgacatcggccccctcttccagaccccccgcgaggtcgcccagcaggccgtcgacgccgacgtccacgccgtcggcgtctccaccctcgccgccggccacaagaccctcgtccccgagctcatcaaggagctcaactccctcggccgccccgacatcctcgtcatgtgcggcggcgtcatccccccccaggactacgagttcctcttcgaggtcggcgtctccaacgtcttcggccccggcacccgcatccccaaggccgccgtccaggtcctcgacgacatcgagaagtgcctcgagaagaagcagcagtccgtctgataataggctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 771 - DNA, 2483 bp, Artificial Sequence
  mRNAs encoding human MCM
tcaagcttttggaccctcgtacagaagctaatacgactcactatagggaaataagagagaaaagaagagtaagaagaaatataagagccaccatgctgcgggcgaagaaccagctgttcctgctaagcccccactacctgcggcaagtgaaggaaagcagcggttcacggctgatccagcagcgcctcctccaccaacagcagcccctccaccccgagtgggccgccctcgccaagaagcaacttaaaggcaagaaccccgaggacctcatttggcacacgcccgagggcatctccatcaagcccctctactctaagcgcgacaccatggacctccccgaagagctccccggcgtcaagcccttcacccgtggaccctaccctaccatgtacaccttccgcccttggactatccgccagtacgctggcttttccaccgtcgaggaatccaacaaattttacaaggacaacatcaaagccggtcaacaaggcctctccgttgccttcgacctcgccacccatcgcggctacgactcggacaacccccgcgtgcgcggcgacgtcggcatggccggcgtcgccatcgacaccgtcgaagataccaagatcctcttcgacggcatcccccttgagaagatgtccgtctccatgaccatgaacggcgccgtcatccccgtactcgcaaactttattgtcaccggcgaggagcaaggcgtgcccaaagagaagctcacgggaaccatacagaacgatatcctcaaggaattcatggtccgcaatacctacatcttcccacccgagccctccatgaaaatcatcgccgacatcttcgagtacaccgccaagcacatgcccaagttcaactcaatctccatctccggctatcatatgcaggaggccggcgccgacgctatcctcgaactcgcttacaccctggctgacggcctcgagtactcccgcacaggcctccaggcaggcttgacaatcgacgagtttgcccccagactctctttcttctggggcatcggcatgaacttctacatggagatagccaaaatgcgcgccggccgccgcctctgggcccaccttattgaaaagatgtttcagcccaagaactccaaatccctcctcctccgtgcccactgccagacctcgggttggtcccttacggagcaggatccctataataacatcgtccgcaccgccatcgaggctatggccgcggtcttcggcggcacccagtccctccacaccaacagtttcgacgaggccctggggctccccaccgtcaaatccgctaggatcgcccgcaacacccaaattattattcaggaagagtccggcatcccaaaagtcgccgatccctggggcggctcctacatgatggagtgcctcaccaacgacgtctacgacgccgccctcaagctcatcaatgaaatcgaggagatgggcggcatggccaaggccgtcgctgagggcatccccaagctccgcatcgaggagtgcgctgcccgccgccaggcccggattgactccggttccgaggtcatagtcggcgtaaacaagtatcaactcgagaaggaagacgctgtcgaggtactcgccatcgacaacaccagtgtccgaaatcgccagatagaaaagctcaagaagattaagtcctcccgcgaccaggccctcgccgagcgctgcctcgccgccctcaccgagtgcgccgcatccggcgacggcaacattttagccctcgccgtcgacgcgtcccgcgcccgctgcaccgtcggcgagatcactgacgccctcaagaaggtcttcggggagcacaaggccaacgatcgcatggtttccggagcctaccgccaggagttcggagagagtaaggagattacctctgccatcaagcgagtccacaagttcatggagagggagggccgccgcccccgcctcctcgtcgccaaaatgggccaggacggccacgaccgcggcgccaaagtcatcgccactggcttcgccgacctcggattcgatgtagacattggccccctcttccaaaccccccgcgaggtggcccagcaggccgtggacgccgacgtccacgccgtcggcgtctccaccctcgccgccggccacaagaccctcgtccccgagctcattaaggagctcaactccctcgggcgcccagacatcctcgtcatgtgcggcggcgtcattcccccccaggactacgagttcttattcgaggtcggcgtcagcaacgtcttcggcccaggaacccggatacccaaagcggcggtccaggtccttgacgatatcgaaaagtgtctcgaaaaaaaacagcagtccgtctgataataggctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 772 - DNA, 2250 bp, Artificial Sequence
  Codon optimized sequence that encodes an MCM polypeptide with the I671V mutation
atgctgcgggcgaagaaccagctgttcctgctaagcccccactacctgcggcaagtgaaggaaagcagcggttcacggctgatccagcagcgcctcctccaccaacagcagcccctccaccccgagtgggccgccctcgccaagaagcaacttaaaggcaagaaccccgaggacctcatttggcacacgcccgagggcatctccatcaagcccctctactctaagcgcgacaccatggacctccccgaagagctccccggcgtcaagcccttcacccgtggaccctaccctaccatgtacaccttccgcccttggactatccgccagtacgctggcttttccaccgtcgaggaatccaacaaattttacaaggacaacatcaaagccggtcaacaaggcctctccgttgccttcgacctcgccacccatcgcggctacgactcggacaacccccgcgtgcgcggcgacgtcggcatggccggcgtcgccatcgacaccgtcgaagataccaagatcctcttcgacggcatcccccttgagaagatgtccgtctccatgaccatgaacggcgccgtcatccccgtactcgcaaactttattgtcaccggcgaggagcaaggcgtgcccaaagagaagctcacgggaaccatacagaacgatatcctcaaggaattcatggtccgcaatacctacatcttcccacccgagccctccatgaaaatcatcgccgacatcttcgagtacaccgccaagcacatgcccaagttcaactcaatctccatctccggctatcatatgcaggaggccggcgccgacgctatcctcgaactcgcttacaccctggctgacggcctcgagtactcccgcacaggcctccaggcaggcttgacaatcgacgagtttgcccccagactctctttcttctggggcatcggcatgaacttctacatggagatagccaaaatgcgcgccggccgccgcctctgggcccaccttattgaaaagatgtttcagcccaagaactccaaatccctcctcctccgtgcccactgccagacctcgggttggtcccttacggagcaggatccctataataacatcgtccgcaccgccatcgaggctatggccgcggtcttcggcggcacccagtccctccacaccaacagtttcgacgaggccctggggctccccaccgtcaaatccgctaggatcgcccgcaacacccaaattattattcaggaagagtccggcatcccaaaagtcgccgatccctggggcggctcctacatgatggagtgcctcaccaacgacgtctacgacgccgccctcaagctcatcaatgaaatcgaggagatgggcggcatggccaaggccgtcgctgagggcatccccaagctccgcatcgaggagtgcgctgcccgccgccaggcccggattgactccggttccgaggtcatagtcggcgtaaacaagtatcaactcgagaaggaagacgctgtcgaggtactcgccatcgacaacaccagtgtccgaaatcgccagatagaaaagctcaagaagattaagtcctcccgcgaccaggccctcgccgagcgctgcctcgccgccctcaccgagtgcgccgcatccggcgacggcaacattttagccctcgccgtcgacgcgtcccgcgcccgctgcaccgtcggcgagatcactgacgccctcaagaaggtcttcggggagcacaaggccaacgatcgcatggtttccggagcctaccgccaggagttcggagagagtaaggagattacctctgccatcaagcgagtccacaagttcatggagagggagggccgccgcccccgcctcctcgtcgccaaaatgggccaggacggccacgaccgcggcgccaaagtcatcgccactggcttcgccgacctcggattcgatgtagacattggccccctcttccaaaccccccgcgaggtggcccagcaggccgtggacgccgacgtccacgccgtcggcgtctccaccctcgccgccggccacaagaccctcgtccccgagctcattaaggagctcaactccctcgggcgcccagacatcctcgtcatgtgcggcggcgtcattcccccccaggactacgagttcttattcgaggtcggcgtcagcaacgtcttcggcccaggaacccggatacccaaagcggcggtccaggtccttgacgatatcgaaaagtgtctcgaaaaaaaacagcagtccgtc

SEQ ID NO: 773 - DNA, 164 bp, Artificial Sequence
  3 prime UTR
tgataatagtccataaagtaggaaacactacagctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 774 - DNA, 141 bp, Artificial Sequence
  3 prime UTR
tgataataggctggagcctcggtggccatgcttcttgccccttgggcctccccccagcccctcctccccttcctgcacccgtaccccccgcattattactcacggtacgagtggtctttgaataaagtctgagtgggcggc

SEQ ID NO: 775 - DNA, 18 bp, Artificial Sequence
  Description of Artificial Sequence: Synthetic oligonucleotide
attgggcacccgtaaggg

The invention claimed is:

1. A lipid nanoparticle comprising a messenger RNA (mRNA) and a compound having the formula:

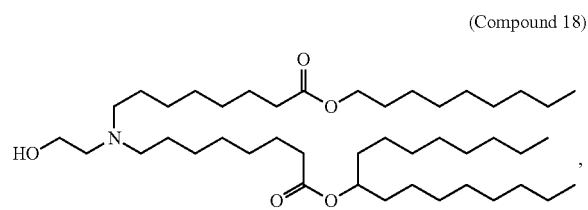 [SMILES: CCCCCCCCCOC(=O)CCCCCCCN(CCO)CCCCCCCC(=O)OC(CCCCCCCC)CCCCCCCC]

(Compound 18)

wherein the mRNA comprises
an open reading frame (ORF) encoding the human methylmalonyl-CoA mutase (MCM) polypeptide of SEQ ID NO:208, SEQ ID NO:209, SEQ ID NO:210, SEQ ID NO:211, SEQ ID NO:212, or SEQ ID NO:213.

2. The lipid nanoparticle of claim 1, wherein the ORF encodes the human MCM polypeptide of SEQ ID NO:213.

3. The lipid nanoparticle of claim 2, wherein the ORF is at least 99% identical to the nucleotide sequence of SEQ ID NO:732.

4. The lipid nanoparticle of claim 2, wherein the ORF is 100% identical to the nucleotide sequence of SEQ ID NO:732.

5. The lipid nanoparticle of claim 2, wherein the mRNA comprises a 5' untranslated region (UTR) comprising the nucleotide sequence of SEQ ID NO:215.

6. The lipid nanoparticle of claim 2, wherein the mRNA comprises a 5' terminal cap comprising a guanine cap nucleotide containing an N7 methylation and the 5'-terminal nucleotide of the mRNA contains a 2'-O-methyl.

7. The lipid nanoparticle of claim 2, wherein the mRNA comprises a poly-A tail 100 residues in length.

8. The lipid nanoparticle of claim 2, wherein at least 95% of uridines in the mRNA are 5-methoxyuridines.

9. The lipid nanoparticle of claim 4, wherein the mRNA comprises a 5' UTR comprising the nucleotide sequence of SEQ ID NO:215.

10. The lipid nanoparticle of claim 4, wherein the mRNA comprises a 5' terminal cap comprising a guanine cap nucleotide containing an N7 methylation and the 5'-terminal nucleotide of the mRNA contains a 2'-O-methyl.

11. The lipid nanoparticle of claim 4, wherein the mRNA comprises a poly-A tail 100 residues in length.

12. The lipid nanoparticle of claim 4, wherein at least 95% of uridines in the mRNA are 5-methoxyuridines.

13. The lipid nanoparticle of claim 4, wherein the mRNA comprises a 5' UTR comprising the nucleotide sequence of SEQ ID NO:215, wherein the mRNA comprises a 5' terminal cap comprising a guanine cap nucleotide containing an N7 methylation and the 5'-terminal nucleotide of the mRNA contains a 2'-O-methyl, wherein the mRNA comprises a poly-A tail 100 residues in length, and wherein at least 95% of uridines in the mRNA are 5-methoxyuridines.

14. The lipid nanoparticle of claim 1, further comprising a phospholipid, a structural lipid, and a PEG lipid.

15. The lipid nanoparticle of claim 4, further comprising a phospholipid, a structural lipid, and a PEG lipid.

16. The lipid nanoparticle of claim 13, further comprising a phospholipid, a structural lipid, and a PEG lipid.

17. The lipid nanoparticle of claim 14, wherein the phospholipid is 1,2-distearoyl-sn-glycero-3-phosphocholine (DSPC) and the structural lipid is cholesterol.

18. The lipid nanoparticle of claim 15, wherein the phospholipid is 1,2-distearoyl-sn-glycero-3-phosphocholine (DSPC) and the structural lipid is cholesterol.

19. The lipid nanoparticle of claim 16, wherein the phospholipid is 1,2-distearoyl-sn-glycero-3-phosphocholine (DSPC) and the structural lipid is cholesterol.

20. The lipid nanoparticle of claim 1, wherein the ORF encodes the human MCM polypeptide of SEQ ID NO:208.

21. The lipid nanoparticle of claim 1, wherein the ORF encodes the human MCM polypeptide of SEQ ID NO:209.

22. The lipid nanoparticle of claim 1, wherein the ORF encodes the human MCM polypeptide of SEQ ID NO:210.

23. The lipid nanoparticle of claim 1, wherein the ORF encodes the human MCM polypeptide of SEQ ID NO:211.

24. The lipid nanoparticle of claim 1, wherein the ORF encodes the human MCM polypeptide of SEQ ID NO:212.

* * * * *